US008168759B2

(12) United States Patent
McKinnon et al.

(10) Patent No.: US 8,168,759 B2
(45) Date of Patent: May 1, 2012

(54) COMPOSITIONS MONOVALENT FOR CD28 BINDING AND METHODS OF USE

(75) Inventors: Murray McKinnon, Washington Crossing, PA (US); Steven G. Nadler, Princeton, NJ (US); Suzanne J. Suchard, Wilmington, DE (US); Brendan Classon, Princeton, NJ (US); Steve Holmes, Cambridge (GB); Olga Ignatovich, Cambridge (GB); Christopher Plummer, Cambridge (GB); Steve Grant, Cambridge (GB)

(73) Assignees: Bristol-Myers Squibb Company, Princeton, NJ (US); Domantis Limited, Brentford, Middlesex (GB)

( * ) Notice: Subject to any disclaimer, the term of this patent is extended or adjusted under 35 U.S.C. 154(b) by 0 days.

(21) Appl. No.: 12/505,166

(22) Filed: Jul. 17, 2009

(65) Prior Publication Data

US 2010/0028354 A1 Feb. 4, 2010

Related U.S. Application Data

(60) Provisional application No. 61/082,078, filed on Jul. 18, 2008, provisional application No. 61/162,121, filed on Mar. 20, 2009.

(51) Int. Cl.
*C07K 16/00* (2006.01)
*A61K 39/395* (2006.01)

(52) U.S. Cl. .................................. 530/387.3; 424/135.1

(58) Field of Classification Search ........................ None
See application file for complete search history.

(56) References Cited

U.S. PATENT DOCUMENTS

| | | | |
|---|---|---|---|
| 2002/0006403 A1 | 1/2002 | Yu et al. | |
| 2003/0170232 A1 | 9/2003 | O'Hara et al. | |
| 2005/0244416 A1 | 11/2005 | Jung | |
| 2008/0038273 A1 | 2/2008 | Soulillou et al. | |
| 2008/0095774 A1 | 4/2008 | O'Hara et al. | |
| 2009/0117108 A1* | 5/2009 | Wang et al. | 424/135.1 |

FOREIGN PATENT DOCUMENTS

| | | |
|---|---|---|
| EP | 1 736484 A1 | 12/2006 |
| EP | 1736484 A1 | 12/2006 |
| WO | WO-2005095456 A1 | 10/2005 |
| WO | WO 2008/071447 | 6/2008 |

OTHER PUBLICATIONS

Blazar et al., J. Immunol., 1996, 157: 3250-3259.*
Grosse-Hovest et al., "A recombinant bispecific single-chain antibody induces targeted, supra-agonistic CD28-stimulation and tumor cell killing," *Eur. J. Immunol.*, 2003, vol. 33, pp. 1334-1340.
Guillonneau et al, "Anti-CD28 Antibodies Modify Regulatory Mechanisms and Reinforce Tolerance in CD40Ig-Treated Heart Allograft Recipients," *The Journal of Immunology*, Dec. 2007, vol. 179, No. 12, pp. 8164-8171.
Jang et al., "A Blocking Anti-CD28-Specific Antibody Induces Long-Term Heart Allograft Survival by Suppression of the PKCθ-JNK Signal Pathway," *Transplantation*, Apr. 15, 2008, vol. 85, No. 7, pp. 1051-1055.
Holt et al., "Domain antibodies: proteins for therapy," *Trends in Biotechnology*, Nov. 2003, vol. 21, No. 11, pp. 484-490.
Ghahroudi et al., "Selection and identification of single domain antibody fragments from camel heavy-chain antibodies," *FEBS Letters*, 1977, vol. 414, pp. 521-526.
Muyldermans, "Single domain camel antibodies: current status," *Molecular Biotechnology*, 2001, vol. 74, pp. 277-302.
Chapman, "PEGylated antibodies and antibody fragments for improved therapy: a review," *Advanced Drug Delivery Reviews*, 2002, vol. 54, pp. 531-545.
Tan et al., "Humanization of an Anti-CD28 Antibody using Germline Human Antibody Sequences," *Blood*, Nov. 1, 2000, vol. 96, No. 11, Abstract only.
Stuart et al., "Targeting T cell costimulation in autoimmune disease," *Expert Opinion on Therapeutic Targets*, Jun. 2002, vol. 6, No. 3, pp. 275-289.
International Search Report issued in International Application No. PCT/US2009/050985 mailed Dec. 2, 2009.
Written Opinion issued in International Application No. PCT/US2009/050985 mailed Dec. 2, 2009.
Vanhove et al., "Selective blockade of DC28 and not CTLA-4 with a single-chain Fv-$\alpha_1$-antitrypsin fusion antibody," Blood, Jul. 15, 2003, vol. 102, No. 2, pp. 564-570.
Nunés et al., "CD28 mAbs with distinct binding properties differ in their ability to induce T cell activation: analysis of early and late activation events," International Immunology, 1992 vol. 5, No. 3, pp. 311-315.
Riley et al., "The CD28 family: a T-cell rheostat for therapeutic control of T-cell activation," Blood, 2005, vol. 105, pp. 13-21.
Sansom et al., "The role of CD28 and cytotoxic T-lymphocyte antigen-4 (CTLA-4) in regulatory T-cell biology," Immunological Reviews, 2006, vol. 212, pp. 131-148.
Adams et al., "Costimulation blockade and tolerance," Current Opinion in Organ Transplantation, 2002, vol. 7, pp. 7-12.
Zhang et al., "Selective CD28 Blockade by a Single-Chain Fv Inhibits T Cell Proliferation and Prevents Acute Rejection in a Murine Model of Cardiac Allotransplantation," The Journal of Heart and Lung Transplantation, vol. 24, No. 262, p. S127 (abstract only).
Moretta et al., "Involvement of T44 Molecules in an Antigen-Independent Pathway of T Cell Activation," J. Exp. Med., Aug. 1985, vol. 162, pp. 823-838.

(Continued)

*Primary Examiner* — Ilia Ouspenski
(74) *Attorney, Agent, or Firm* — Drinker Biddle & Reath LLP

(57) ABSTRACT

Disclosed are domain antibodies that monovalently bind CD28. Domain antibodies that are monovalent for binding of CD28 can inhibit CD28 activity. In one aspect, a domain antibody consists of or comprises a single immunoglobulin variable domain that specifically binds and antagonizes the activity of CD28, in an aspect, without substantially agonizing CD28 activity. In another aspect, the domain antibody is a human domain antibody. The disclosure further encompasses methods of antagonizing CD80 and/or CD86 interactions with CD28 in an individual and methods of treating diseases or disorders involving CD80 and/or CD86 interactions with CD28, the methods involving administering a domain antibody to the individual.

13 Claims, 9 Drawing Sheets

OTHER PUBLICATIONS

Ledbetter et al., "CD28 ligation in T-cell activation: evidence for two signal transduction pathways," Blood, 1990, vol. 75, pp. 1531-1539.

Ledbetter et al., "Crosslinking of surface antigens causes mobilization of intracellular ionized calcium in T lymphocytes," Proc. Natl. Acad. Sci., Mar. 1987, vol. 84, pp. 1384-1388.

Nunés et al., "The Role of $p21^{ras}$ in CD28 Signal Transduction: Triggering of CD28 with Antibodies, but Not the Ligand B7-1, Activates $p21^{ras}$," J. Exp. Med., Sep. 1994, vol. 180, pp. 1067-1076.

Dennehy et al., "Mitogenic signals through CD28 activate the protein kinase C0-NF-κB pathway in primary peripheral T cells," International Immunology, 2002, vol. 15, No. 5, pp. 655-663.

Elflein et al, "Rapid recovery from T lymphopenia by CD28 superagonist therapy," Blood, Sep. 1, 2003, vol. 102, No. 5, pp. 1764-1770.

Tacke et al., "CD28-mediated induction of proliferation in resting T cells in vitro and in vivo without engagement of the T cell receptor: evidence for functionally distinct forms of CD28," Eur. J. Immunol., 1997, vol. 27, pp. 239-247.

Bischof et al., "Autonomous induction of proliferation, JNK and NF-χB activation in primary resting T cells by mobilized CD28," Eur. J. Immunol., 2000, vol. 30, pp. 876-882.

Ledbetter et al., "Antibody Binding to CD5 (Tp67) and Tp44 Cell Surface Molecules: Effects on Cyclic Nucleotides, Cytoplasmic Free Calcium, and cAMP Mediated Suppression," The Journal of Immunology, Nov. 15, 1996, vol. 137, No. 10, pp. 3299-3305.

Hansen et al., "Monoclonal Antibodies Identifying a Novel T-Cell Antigen in Ia Antigens of Human Lymphocytes," Immunogenetics, 1980, vol. 10, pp. 247-260.

Margulies, "CD28, Costimulator or Agonist Receptor?" The Journal of Experimental Medicine, Apr. 21, 2003, vol. 197, No. 8, pp. 949-953.

Luhder et al., "Topological Requirements and Signaling Properties of T Cell-activating, Anti-CD28 Antobidy Superagonists," J. Exp. Med., Apr. 21, 2003, vol. 197, No. 8, pp. 955-966.

Tan et al., "Superhumanized Antobodies: Reduction of Immunogenic Potential by Complementarity-Determining Region Grafting with Human Germline Sequences: Application to an Anti-CD28," The Journal of Immunology, 2002, pp. 1119-1125.

Haspot et al., "Differential effect of CD28 Versus B7 Blockade on Direct Pathway of Allorecognition and Self-Restricted Responses", Blood, Mar. 15, 2002, pp. 2228-2234, vol. 99, No. 6.

Yi et al., "CD28/B7-Mediated Costimulation is Required for Parathyroid Gland Allograft Rejection in Rats", Chinese Medical Sciences Journal, Sep. 1999, pp. 158-162, vol. 14, No. 3.

Perrin et al., "Blockade of CD28 During in Vitro Activation of Encephalitogenic T Cells or After Disease Onset Ameliorates Experimental Autoimmune Encephalomyelitis", J. Immunology, vol. 163, 1999, pp. 1704-1710.

Dengler et al., "Prolonged Allograft Survival But No Tolerance Induction by Modulating CD28 Antibody JJ319 After High-Responder Rat Heart Transplantation", Transplantation, Feb. 15, 1999, pp. 392-398, vol. 67, No. 3.

Yu et al., "CD28-Specific Antibody Prevents Graft-Versus-Host Disease in Mice", J. Immunology, 2000, vol. 164, pp. 4564-4568.

Ian M. Tomlinson et al., "The Structural Repertoire of the Human Vκ Domain", The EMBO Journal, 1995, pp. 4628-4638, vol. 14, No. 18.

International Preliminary Report on Patentability issued Jan. 27, 2011 in International Application No. PCT/US2009/050985 filed Jul. 17, 2009.

New Zealand Examination Report issued Jun. 10, 2011 in New Zealand Patent Application No. 590343.

* cited by examiner

FIG. 7

COMPOSITIONS MONOVALENT FOR CD28 BINDING AND METHODS OF USE

REFERENCE TO RELATED APPLICATIONS

This application claims the benefit of U.S. Provisional Application No. 61/162,121, filed Mar. 20, 2009, and U.S. Provisional Application No. 61/082,078, filed Jul. 18, 2008, which are herein incorporated by reference in their entirety.

FIELD OF THE INVENTION

Domain antibodies (dAbs) that bind CD28 and prevent the binding of CD28 to CD80 and/or CD86, wherein the dAbs do not cross-react with CTLA4, and methods of using the same are provided.

SEQUENCE LISTING

The Sequence Listing attached below is incorporated herein by reference.

BACKGROUND

Antigen-nonspecific intercellular interactions between T-lymphocytes and antigen-presenting cells (APCs) generate T cell co-stimulatory signals that generate T cell responses to antigen (Jenkins and Johnson (1993) Curr. Opin. Immunol. 5: 361-367). Co-stimulatory signals determine the magnitude of a T cell response to antigen and whether this response activates or inactivates subsequent responses to antigen (Mueller et al. (1989) Annu. Rev. Immunol. 7: 445-480). T cell activation in the absence of co-stimulation results in an aborted or anergic T cell response (Schwartz, R. H. (1992) Cell 71: 1065-1068). One key co-stimulatory signal is provided by interaction of the T cell surface receptor CD28 with B7-related molecules on antigen presenting cells (e.g., B7-1 and B7-2, or CD80 and CD86, respectively) (P. Linsley and J. Ledbetter (1993) Annu. Rev. Immunol. 11: 191-212). The interaction of CD28 with B7-1 (CD80) and B7-2 (CD86) co-stimulatory molecules provides a major signaling pathway for augmenting and sustaining T cell responses (Freedman et al. (1987) J. Immunol. 137: 3260-3267; Freeman et al. (1989) J. Immunol. 143: 2714-2722; Freeman et al. (1991) J. Exp. Med. 174: 625-631; Freeman et al. (1993) Science 262: 909-911; Azuma et al. (1993) Nature 366: 76-79; Freeman et al. (1993) J. Exp. Med. 178: 2185-2192).

CD28 is constitutively expressed on the surface of T cells, virtually all human CD4+ T cells, to a lesser extent on human CD8+ T cells, some natural killer cells and all murine T cells. CD28 is a type I transmembrane glycoprotein and is a member of the Immunoglobulin family by virtue of its single Ig variable-like extracellular domain which has a MYPPPY (SEQ ID NO: 639) motif required for binding CD80 and CD86 (Peach et al. 1994, J. Exp. Med. 180: 2049-2058). CD28 has a cysteine residue located after the Ig variable-like domain, which is involved in its homodimerization. The protein sequence of CD28 and a nucleic acid encoding a human CD28 are disclosed, for example, in Harper et al. J. Immunol. (1991) 147: 1037-44. The sequence of a human mRNA encoding CD28 also is disclosed in NCBI Accession No. NM_006139, last updated Apr. 19, 2009, for example. The complete protein sequence of a human CD28 also is disclosed in NCBI Accession No. NP_006130, last updated Apr. 19, 2009, for example.

CD28 transmits a signal that synergizes with the T cell receptor (TCR) signal to promote the activation of naïve T cells (Lanzavecchia et al. (1999) Cell 96: 1-4). CD28 signaling regulates the threshold for T cell activation and significantly reduces the number of TCR engagements needed for effective T cell activation (Viola et al. (1996) Science 273: 104-6). CD28 co-stimulation results in enhanced T cell proliferation, production of multiple cytokines and cytokine receptors, increased expression of proteins involved in cell cycle progression, sustaining T cell survival, and sustained CD40Ligand (CD40L) expression on T cells (Sharpe et al. Fundamental Immunology, W. E. Paul Ed. Fifth Edition, Page 396).

CD28 signals have a critical role in regulating CD4 and CD8 T cell differentiation. CD28 also optimizes the responses of previously activated T cells, promoting IL-2 production and T cell survival. IL-4 production by naïve T cells is highly dependent on B7-1/B7-2 co-stimulation. Interruption of the CD28/B7 pathway during activation of naïve T cells impairs T cell proliferation and differentiation, while interruption of the CD28/B7 pathway in previously activated T cells diminishes T cell expansion but not effector cytokine production (Sharpe et al. Fundamental Immunology, W. E. Paul Ed. Fifth Edition, pages 393-404).

T helper cell-dependent antibody responses use the B7-CD28 pathway to provide co-stimulatory signals essential for cognate T cell/B cell interactions required for Immunoglobulin class switching and germinal center formation. In CD28 knock-out mice, potentially reactive B cells accumulate within lymphoid follicles after antigenic stimulation, but are not able to proliferate or undergo somatic mutation, (Ferguson et al. (1996) J. Immunol. 156: 4576-4581).

B7-1 and B7-2 are also ligands for a second, higher affinity receptor, CTLA4 (CD152), which is present on the surface of activated T cells. B7-1/B7-2 co-stimulation of inhibitory signals occurs when B7-1/B7-2 bind CTLA-4 (Brunet et al. (1987) Nature 328: 267-270, Linsley et al. (1991) J. Exp. Med. 174: 561-569). The outcome of an immune response involves a balance between CD28 mediated T cell activation and CTLA-4 mediated T cell inhibition.

Inhibition of CD28 mediated T cell activation could inhibit undesired T cell responses occurring during autoimmunity, transplant rejection, or allergic responses. For example, inhibiting CD28 mediated T cell activation could delay graft rejection, prevent acute allograft rejection, induce donor specific tolerance, and prevent development and interrupt the progression of chronic allograft rejection, as well as prevent graft versus host disease (GVH), i.e., when transplanted T cells mount a vigorous immune response against host tissue alloantigens (Salama et al. (2001) J. Clin. Invest. 108: 943-48). Not only would inhibiting CD28 mediated T cell activation dampen the immune response through negating activation signaling through CD28, it should not impact the interaction of CD86 and CD80 to CTLA-4, thereby preserving CTLA-4 mediated inhibition of the T cell response. Thus, inhibiting CD28 mediated T cell activation could be used to prevent induction of autoimmunity and moderate the progression and/or severity of established autoimmune diseases, including models of collagen induced arthritis, autoimmune thyroiditis, autoimmune uveitis, myasthenia gravis and lupus (Saloman et al. (2001) Ann. Rev. Immunol. 19: 225-252).

What is needed is a way to inhibit CD28-mediated T cell activation, without stimulation of CD28 signaling pathways. The disclosure set forth herein meets and addresses this need.

SUMMARY

Provided herein are domain antibodies (dAbs) that monovalently bind CD28. Because of the clear importance of CD28 in the regulation of the T cell response and the production of antibodies, the CD28/B7 (CD80 and CD86) interaction and pathways present important targets for the development of therapeutic approaches for the treatment of diseases and disorders that involve inappropriate cellular responses, such as transplant rejection, autoimmunity, and/or excessive antibody responses. Domain antibodies that are monovalent for binding of CD28 can inhibit CD28 activity, dampening an immune response, while avoiding potential undesirable effects that can occur with antibodies capable of divalent or multivalent binding of CD28. Domain antibodies can also be applied to any of a number of uses for which standard divalent antibodies are also used, e.g., in vivo imaging and diagnosis.

Accordingly, described herein are domain antibodies that bind CD28 and prevent or inhibit the binding of CD28 to CD80, CD86 and/or other ligands and inhibit CD28 signaling by CD80 and/or CD86 in receptor binding assays. Domain antibodies described herein also do not block the interaction of CD80 and CD86 to CTLA4. In an embodiment, domain antibodies described herein do not cross-react with CTLA4, and thus do not bind the common motif on CTLA4 and CD28 that binds CD80/86.

In one embodiment, the binding of the domain antibody to CD28 does not substantially agonize CD28 activity. In particular, the dAb does not agonize CD28 signaling in combination with T cell receptor signaling. In another embodiment, the domain antibody inhibits the binding of CD28 to CD80. In another embodiment, the domain antibody inhibits the binding of CD28 to CD80, and does not substantially agonize signaling by CD28. In yet another embodiment, the domain antibody inhibits the binding of CD28 to CD86. In another embodiment, the domain antibody inhibits the binding of CD28 to CD86, and does not substantially agonize signaling by CD28. Also included is a dAb that interferes with the binding of CD80 and/or CD86 to the MYPPPY (SEQ ID NO: 639) sequence of CD28

In an aspect, the dAb does not substantially induce T cell proliferation in combination with T cell receptor signaling. In another aspect, the dAb does not substantially induce cytokine secretion by T cells in combination with T cell receptor signaling. In an embodiment, a cytokine is at least one cytokine selected from the group consisting of GM-CSF, IL-2, IL-3, IL-4, IL-5, IL-6, IL-10, IL-12 IL-13, IL-15, IL-17, IL-21, IL-22, IL-24, TGFβ, TNF-α, TNF-β, IFN-α, IFN-β, IFN-γ.

In one aspect, because human antibodies will avoid the generation of an immune response to the antibodies when administered to human subjects for the treatment or prevention of disease, the domain antibody is a human domain antibody that monovalently binds CD28, and in an exemplary embodiment, without substantially agonizing CD28 activity.

In one embodiment, the domain antibody interacts with human CD28 with a $K_d$ in the range of 50 nM to 1 pM, inclusive, as measured by surface plasmon resonance. For example, the $K_d$ for human CD28 can be 25 nM to 20 pM, 10 nM to 20 pM, 5 nm to 20 pM, 1 nM to 20 pM, 0.5 nM to 20 pM, 0.1 nM to 20 pM, 0.1 nM to 50 pM, 75 pM to 20 pM, or even 50 pM to 20 pM. In an embodiment, the $K_d$ for human CD28 is about 50 pM.

In one embodiment, the domain antibody inhibits binding of CD80 to CD28 with an $IC_{50}$ of 50 nM or less. In one embodiment, the domain antibody inhibits binding of CD86 to CD28 with an $IC_{50}$ of 50 nM or less. In a further embodiment, the domain antibody has binding specificity to CD28 with a $K_{off}$ rate constant of $1\times10^{-3}$ $s^{-1}$ or less, $1\times10^{-4}$ $s^{-1}$ or less, $1\times10^{-5}$ $s^{-1}$ or less, or $1\times10^{-6}$ $s^{-1}$ or less, as determined by surface plasmon resonance. In one embodiment, the domain antibody neutralizes CD28 in a standard assay with a $IC_{50}$ of 50 nM or less.

In another embodiment, the domain antibody comprises a single immunoglobulin variable domain that binds CD28. In one embodiment, the single immunoglobulin variable domain is a $V_H$ or a $V_L$ domain. In another embodiment, the domain antibody comprises a homomultimer or heteromultimer of two variable domains, e.g., a $V_H$ and $V_L$ domain, but one of the variable domains has the capacity to bind CD28 without the need for a corresponding $V_L$ or $V_H$ domain. That is, the dAb binds antigen independently of the additional $V_H$ or $V_L$ domains. The variable domains in these embodiments may comprise three complementarity determining regions (CDRs). In another embodiment, the domain antibody is free of an Fc domain. The limits of an Fc domain are set out in Kabat et al. (1991, Sequences of Immunological Interest, 5$^{th}$ ed. U.S. Dept. Health & Human Services, Washington, D.C.; incorporated herein by reference). In the alternative, an Fc domain consists of the CH2-CH3 regions, optionally including a hinge region linked to the CH2.

In one aspect, the domain antibody comprises a universal framework. In this aspect, a domain antibody may comprise one or more framework regions comprising an amino acid sequence that is the same as the amino acid sequence of a corresponding framework (FW) region encoded by a human germline antibody gene segment, or the amino acid sequence of one or more of said framework regions collectively comprising up to 5, e.g., 1, 2, 3, 4 or 5, amino acid differences relative to the amino acid sequence of said corresponding framework region encoded by a human germline antibody gene segment.

In one embodiment, the dAb comprises amino acid sequences of FW1, FW2, FW3, and FW4 that correspond to the FW1, FW2, FW3, and FW4 of a human antibody, e.g., a human germline antibody. In a further embodiment, some or all of the amino acid sequences of FW1, FW2, FW3, and FW4 of the domain antibody are the same as the amino acid sequences of corresponding framework regions encoded by human germline antibody gene segments. For example, FW2 may be identical to the FW2 of a human antibody. In another embodiment, the amino acid sequences of FW1, FW2, FW3, and FW4 collectively contain up to 10 amino acid differences relative to the amino acid sequences of corresponding framework regions encoded by said human germline antibody gene segment. In a further embodiment of the foregoing, the human germline antibody gene segment can be selected from the group consisting of DP47, DP45, DP48, and DPK9. In one embodiment, the universal framework comprises a $V_H$ framework selected from the group consisting of DP47, DP45, and DP38, and/or the $V_L$ framework is DPK9.

In one aspect, a domain antibody is formatted to increase its in vivo half-life. In particular, the domain antibody has an increased in vivo t-α or t-β half-life relative to the same unformatted domain antibody.

In one embodiment, the α-half-life of the domain antibody composition is increased by 10% or more when compared to an unmodified protein assayed under otherwise identical conditions. In another embodiment, the α-half-life of the domain antibody composition is increased by 50% or more. In another embodiment, the tα-half-life of the domain antibody composition is increased by 2× or more. In another embodiment, the tα-half-life of the domain antibody composition is increased by 5× or more, e.g., 10×, 15×, 20×, 25×, 30×, 40×, 50×, or more. In another embodiment, the tα-half-life of the domain antibody composition is increased by 100×, 200×, 300×, 400×, 500×, or more.

In another embodiment, the domain antibody has a tα half-life of 0.25 to 6 hours, inclusive. In another embodiment, the tα half-life is in the range of 30 minutes to 12 hours, inclusive. In another embodiment, the tα-half-life of the domain antibody is in the range of 1 to 6 hours.

In another embodiment, the tβ-half-life of the domain antibody is increased by 10% or more when compared to an unmodified protein assayed under otherwise identical conditions. In another embodiment, the tβ-half-life of the domain antibody is increased by 50% or more. In another embodiment, the tβ-half-life of the antibody domain antibody is increased by 2× or more. In another embodiment, the tβ-half-life of the domain antibody is increased by 5× or more, e.g., 10×, 15×, 20×, 25×, 30×, 40×, or more. In another embodiment, the tβ-half-life of the domain antibody is increased by 50× or more.

In another embodiment, the domain antibody has a tβ half-life of 1 hour to 744 hours, inclusive. In another embodiment, the tβ-half-life is in the range of 12 to 48 hours, inclusive. In another embodiment, the tβ half-life is in the range of 12 to 26 hours, inclusive. In yet another embodiment, the tβ half-life is about 336 hours.

In addition to, or alternative to the above criteria, a domain antibody-containing composition is provided comprising a ligand having an AUC value (area under the curve) in the range of 1 mg·min/ml or more. In one embodiment, the lower end of the range is 5, 10, 15, 20, 30, 100, 200, or 300 mg·min/ml. In addition, or alternatively, a ligand or composition has an AUC in the range of up to 600 mg·min/ml. In one embodiment, the upper end of the range is 500, 400, 300, 200, 150, 100, 75, or 50 mg·min/ml. Advantageously a ligand will have an AUC in the range selected from the group consisting of the following: 15 to 150 mg·min/ml, 15 to 100 mg·min/ml, 15 to 75 mg·min/ml, and 15 to 50 mg·min/ml.

In one formatting embodiment, the domain antibodies described herein can be linked to human serum albumin (HSA), which also has the effect of increasing the in vivo half-life of the molecule. The human serum albumin coding sequences can be obtained by PCR using primers derived from the cDNA sequence available at GenBank Accession No. NM000477. Such coding sequences can be fused to the coding sequence for a domain antibody as described herein, and the fusion can be expressed by one of skill in the art. In one embodiment, the tα-half-life of the HSA-linked domain antibody composition is increased by 10% or more. In another embodiment, the tα-half-life of the HSA-linked domain antibody composition is in the range of 0.25 hours to 6 hours. In another embodiment, the tβ-half-life of the HSA-linked domain antibody composition is increased by 10% or more. In another embodiment, the tβ-half-life of the HSA-linked domain antibody composition is in the range of 12 to 48 hours.

In another embodiment, the formatting comprises PEGylation of the dAb. In one embodiment, the PEG is covalently linked. In another embodiment, the PEG is linked to the domain antibody at a cysteine or lysine residue. In yet another embodiment, the PEG-linked domain antibody has a hydrodynamic size of at least 24 kD. In yet another embodiment, the total PEG size is from 20 to 60 kD, inclusive. In yet another embodiment, the PEG-linked domain antibody has a hydrodynamic size of at least 200 kD.

In another embodiment, the PEG-linked domain antibody has an increased in vivo half-life relative to the same polypeptide composition lacking linked polyethylene glycol. In another embodiment, the tα-half-life of the domain antibody composition is increased by 10% or more. In another embodiment, the tα-half-life of the domain antibody composition is increased by 50% or more. In another embodiment, the tα-half-life of the domain antibody composition is increased by 2× or more. In another embodiment, the tα-half-life of the domain antibody composition is increased by 5× or more, e.g., 10×, 15×, 20×, 25×, 30×, 40×, 50×, or more. In another embodiment, the tα-half-life of the domain antibody composition is increased by 100×, 200×, 300×, 400×, 500×, or more.

In another embodiment, the PEG-linked domain antibody has a tα half-life of 0.25 to 6 hours, inclusive. In another embodiment, the tα half-life is in the range of 30 minutes to 12 hours, inclusive. In another embodiment, the tα-half-life of the domain antibody is in the range of 1 to 6 hours.

In another embodiment, the tβ-half-life of the PEG-linked domain antibody is increased by 10% or more. In another embodiment, the tβ-half-life of the PEG-linked domain antibody is increased by 50% or more. In another embodiment, the tβ-half-life of the PEG-linked domain antibody is increased by 2× or more. In another embodiment, the tβ-half-life of the PEG-linked domain antibody is increased by 5× or more, e.g., 10×, 15×, 20×, 25×, 30×, 40×, or more. In another embodiment, the tβ-half-life of the PEG-linked domain antibody is increased by 50× or more.

In another embodiment, the PEG-linked domain antibody has a tβ half-life of 1 to 170 hours, inclusive. In another embodiment, the tβ-half-life is in the range of 12 to 48 hours, inclusive. In another embodiment, the tβ-half-life is in the range of 12 to 26 hours, inclusive.

In another embodiment, the PEG-linked domain antibody has an AUC value (area under the curve) in the range of 1 mg·min/ml or more. In one embodiment, the lower end of the range is about 5, 10, 15, 20, 30, 100, 200, or 300 mg·min/ml. In addition, or alternatively, a ligand or composition has an AUC in the range of up to about 600 mg·min/ml. In one embodiment, the upper end of the range is about 500, 400, 300, 200, 150, 100, 75, or 50 mg·min/ml. Advantageously a ligand will have an AUC in the range selected from the group consisting of the following: about 15 to 150 mg·min/ml, about 15 to 100 mg·min/ml, about 15 to 75 mg·min/ml, and about 15 to 50 mg·min/ml.

In another embodiment is provided a domain antibody which has an amino acid sequence at least 85% identical, e.g., at least 90% identical, at least 95% identical, and up to and including 96%, 97%, 98%, or 99% identical, to an amino acid sequence encoded by a nucleic acid molecule having a sequence selected from the group consisting of SEQ ID NOS: 1-57, which domain antibody specifically and monovalently binds CD28.

In another embodiment, the domain antibody comprises an amino acid sequence selected from the group consisting of SEQ ID NOs:58-398 and 640, and SEQ ID NOs:532-635, and in an exemplary embodiment, SEQ ID NO:58, SEQ ID NO:59, SEQ ID NO:60, SEQ ID NO:61, SEQ ID NO:62, SEQ ID NO:63, SEQ ID NO:64, SEQ ID NO:65, SEQ ID NO:66, SEQ ID NO:67, SEQ ID NO:68, SEQ ID NO:272, SEQ ID NO:273, SEQ ID NO:274, SEQ ID NO:275, SEQ ID NO:276, SEQ ID NO:534, SEQ ID NO:535, SEQ ID NO:536, SEQ ID NO:537, SEQ ID NO:539, SEQ ID NO:540, SEQ ID NO:542, SEQ ID NO:543, SEQ ID NO:545, SEQ ID NO:547, SEQ ID NO:548, SEQ ID NO:550, SEQ ID NO:551, SEQ ID NO:553, SEQ ID NO:562, SEQ ID NO:567, SEQ ID NO:570, SEQ ID NO:575, SEQ ID NO:576, SEQ ID NO:577, SEQ ID NO:578, SEQ ID NO:580, SEQ ID NO:599, SEQ ID NO:600, SEQ ID NO:607, SEQ ID NO:611, SEQ ID NO:617, and SEQ ID NO:622.

In yet another aspect, domain antibody is provided for which has an amino acid sequence at least 70%, 75%, 80%, 85%, 90%, 95%, 96%, 97%, 98%, or 99% identical to an amino acid sequence selected from the group consisting of SEQ ID NO:58, SEQ ID NO:59, SEQ ID NO:60, SEQ ID NO:61, SEQ ID NO:62, SEQ ID NO:63, SEQ ID NO:64, SEQ ID NO:65, SEQ ID NO:66, SEQ ID NO:67, SEQ ID NO:68, SEQ ID NO:272, SEQ ID NO:273, SEQ ID NO:274, SEQ ID NO:275, SEQ ID NO:276, SEQ ID NO:534, SEQ ID NO:535, SEQ ID NO:536, SEQ ID NO:537, SEQ ID NO:539, SEQ ID NO:540, SEQ ID NO:542, SEQ ID NO:543, SEQ ID NO:545, SEQ ID NO:547, SEQ ID NO:548, SEQ ID NO:550, SEQ ID NO:551, SEQ ID NO:553, SEQ ID NO:562, SEQ ID NO:567, SEQ ID NO:570, SEQ ID NO:575, SEQ ID NO:576, SEQ ID NO:577, SEQ ID NO:578, SEQ ID NO:580, SEQ ID NO:599, SEQ ID NO:600, SEQ ID NO:607, SEQ ID NO:611, SEQ ID NO:617, and SEQ ID NO:622, which polypeptide specifically and monovalently binds CD28. In another embodiment, a domain antibody differs from the selected amino acid sequence at no more than 25 amino acid positions and has a sequence that is at least 80% identical to the selected sequence. In one embodiment, the domain antibody differs from the selected amino acid sequence at 25 or fewer amino acid positions, 20 or fewer amino acid positions, 15 or fewer amino acid positions, 10 or fewer amino acid positions, 5 or fewer amino acid positions, 2 or fewer amino acid positions, or as few as one amino acid position. In a further embodiment, the domain antibody is at least 80% identical to the selected sequence, for example, at least 70% identical, at least 75% identical, at least 80% identical, at least 85% identical, at least 90% identical, at least 95% identical, and up to and including 96%, 97%, 98%, or 99% identical.

In one embodiment, a CD28 antagonist has a CDR1 sequence that is at least 50% identical to the CDR1 sequence of the amino acid sequence selected from the group consisting of SEQ ID NO:58, SEQ ID NO:59, SEQ ID NO:60, SEQ ID NO:61, SEQ ID NO:62, SEQ ID NO:63, SEQ ID NO:64, SEQ ID NO:65, SEQ ID NO:66, SEQ ID NO:67, SEQ ID NO:68, SEQ ID NO:272, SEQ ID NO:273, SEQ ID NO:274, SEQ ID NO:275, SEQ ID NO:276, SEQ ID NO:534, SEQ ID NO:535, SEQ ID NO:536, SEQ ID NO:537, SEQ ID NO:539, SEQ ID NO:540, SEQ ID NO:542, SEQ ID NO:543, SEQ ID NO:545, SEQ ID NO:547, SEQ ID NO:548, SEQ ID NO:550, SEQ ID NO:551, SEQ ID NO:553, SEQ ID NO:562, SEQ ID NO:567, SEQ ID NO:570, SEQ ID NO:575, SEQ ID NO:576, SEQ ID NO:577, SEQ ID NO:578, SEQ ID NO:580, SEQ ID NO:599, SEQ ID NO:600, SEQ ID NO:607, SEQ ID NO:611, SEQ ID NO:617, and SEQ ID NO:622.

In one embodiment, the CDR1 differs from the selected amino acid sequence at all CDR1 amino acid positions, 5 or fewer amino acid positions, 4 or fewer amino acid positions, 3 or fewer amino acid positions, 2 or fewer amino acid positions, or as few as one amino acid position. In a further embodiment, the CDR1 is at least 50% identical to the selected sequence, for example, at least 60% identical, at least 70% identical, at least 75% identical, at least 80% identical, at least 85% identical, at least 90% identical, at least 95% identical, and up to and including 96%, 97%, 98%, or 99% identical.

In one embodiment, a CD28 antagonist has a CDR2 sequence that is at least 50% identical to the CDR2 sequence of the amino acid sequence selected from the group consisting of SEQ ID NO:58, SEQ ID NO:59, SEQ ID NO:60, SEQ ID NO:61, SEQ ID NO:62, SEQ ID NO:63, SEQ ID NO:64, SEQ ID NO:65, SEQ ID NO:66, SEQ ID NO:67, SEQ ID NO:68, SEQ ID NO:272, SEQ ID NO:273, SEQ ID NO:274, SEQ ID NO:275, SEQ ID NO:276, SEQ ID NO:534, SEQ ID NO:535, SEQ ID NO:536, SEQ ID NO:537, SEQ ID NO:539, SEQ ID NO:540, SEQ ID NO:542, SEQ ID NO:543, SEQ ID NO:545, SEQ ID NO:547, SEQ ID NO:548, SEQ ID NO:550, SEQ ID NO:551, SEQ ID NO:553, SEQ ID NO:562, SEQ ID NO:567, SEQ ID NO:570, SEQ ID NO:575, SEQ ID NO:576, SEQ ID NO:577, SEQ ID NO:578, SEQ ID NO:580, SEQ ID NO:599, SEQ ID NO:600, SEQ ID NO:607, SEQ ID NO:611, SEQ ID NO:617, and SEQ ID NO:622.

In one embodiment, the CDR2 differs from the selected amino acid sequence at all CDR2 amino acid positions, 5 or fewer amino acid positions, 4 or fewer amino acid positions, 3 or fewer amino acid positions, 2 or fewer amino acid positions, or as few as one amino acid position. In a further embodiment, the CDR2 is at least 50% identical to the selected sequence, for example, at least 60% identical, at least 70% identical, at least 75% identical, at least 80% identical, at least 85% identical, at least 90% identical, at least 95% identical, and up to and including 96%, 97%, 98%, or 99% identical.

In one embodiment, a CD28 antagonist has a CDR3 sequence that is at least 50% identical to the CDR2 sequence of the amino acid sequence selected from the group consisting of SEQ ID NO:58, SEQ ID NO:59, SEQ ID NO:60, SEQ ID NO:61, SEQ ID NO:62, SEQ ID NO:63, SEQ ID NO:64, SEQ ID NO:65, SEQ ID NO:66, SEQ ID NO:67, SEQ ID NO:68, SEQ ID NO:272, SEQ ID NO:273, SEQ ID NO:274, SEQ ID NO:275, SEQ ID NO:276, SEQ ID NO:534, SEQ ID NO:535, SEQ ID NO:536, SEQ ID NO:537, SEQ ID NO:539, SEQ ID NO:540, SEQ ID NO:542, SEQ ID NO:543, SEQ ID NO:545, SEQ ID NO:547, SEQ ID NO:548, SEQ ID NO:550, SEQ ID NO:551, SEQ ID NO:553, SEQ ID NO:562, SEQ ID NO:567, SEQ ID NO:570, SEQ ID NO:575, SEQ ID NO:576, SEQ ID NO:577, SEQ ID NO:578, SEQ ID NO:580, SEQ ID NO:599, SEQ ID NO:600, SEQ ID NO:607, SEQ ID NO:611, SEQ ID NO:617, and SEQ ID NO:622.

In one embodiment, the CDR3 differs from the selected amino acid sequence at all CDR3 amino acid positions, 5 or fewer amino acid positions, 4 or fewer amino acid positions, 3 or fewer amino acid positions, 2 or fewer amino acid positions, or as few as one amino acid position. In a further embodiment, the CDR2 is at least 50% identical to the selected sequence, for example, at least 60% identical, at least 70% identical, at least 75% identical, at least 80% identical, at least 85% identical, at least 90% identical, at least 95% identical, and up to and including 96%, 97%, 98%, or 99% identical.

Further included is a dAb comprising a CDR1 sequence at least 50% identical to one of the CDR1 sequences selected from the group consisting of SEQ ID NO:484, SEQ ID NO:487, SEQ ID NO:490, SEQ ID NO:493, SEQ ID NO:496, SEQ ID NO:499, SEQ ID NO:502, SEQ ID NO:505, SEQ ID NO:508, SEQ ID NO:511, SEQ ID NO:514, SEQ ID NO:517, SEQ ID NO:520, SEQ ID NO:523, SEQ ID NO:526, SEQ ID NO:529 and SEQ ID NO:636; a CDR2 sequence at least 50% identical to one of the CDR2 sequences selected from the group consisting of SEQ ID NO:485, SEQ ID NO:488, SEQ ID NO:491, SEQ ID NO:494, SEQ ID NO:497, SEQ ID NO:500, SEQ ID NO:503, SEQ ID NO:506, SEQ ID NO:509, SEQ ID NO:512, SEQ ID NO:515, SEQ ID NO:518, SEQ ID NO:521, SEQ ID NO:524, SEQ ID NO:527, SEQ ID NO:530 and SEQ ID NO:637; and a CDR3 sequence at least 50% identical to one of the CDR3 sequences selected from the group consisting of SEQ ID NO:486, SEQ ID NO:489, SEQ ID NO:492, SEQ ID NO:495, SEQ ID NO:498, SEQ ID NO:501, SEQ ID NO:504, SEQ ID NO:507, SEQ ID NO:510, SEQ ID NO:513, SEQ ID NO:516, SEQ ID NO:519, SEQ ID NO:522, SEQ ID NO:525, SEQ ID NO:528, SEQ ID NO:531 and SEQ ID NO:638.

In another aspect, included is a dAb comprising a CDR1 sequence selected from the group consisting of SEQ ID NO:484, SEQ ID NO:487, SEQ ID NO:490, SEQ ID NO:493, SEQ ID NO:496, SEQ ID NO:499, SEQ ID NO:502, SEQ ID NO:505, SEQ ID NO:508, SEQ ID NO:511, SEQ ID NO:514, SEQ ID NO:517, SEQ ID NO:520, SEQ ID NO:523, SEQ ID NO:526, SEQ ID NO:529 and SEQ ID NO:636; a CDR2 sequence selected from the group consisting of SEQ ID NO:485, SEQ ID NO:488, SEQ ID NO:491, SEQ ID NO:494, SEQ ID NO:497, SEQ ID NO:500, SEQ ID NO:503, SEQ ID NO:506, SEQ ID NO:509, SEQ ID NO:512, SEQ ID NO:515, SEQ ID NO:518, SEQ ID NO:521, SEQ ID NO:524, SEQ ID NO:527, SEQ ID NO:530 and SEQ ID NO:637; and a CDR3 sequence selected from the group consisting of SEQ ID NO:486, SEQ ID NO:489, SEQ ID NO:492, SEQ ID NO:495, SEQ ID NO:498, SEQ ID NO:501, SEQ ID NO:504, SEQ ID NO:507, SEQ ID NO:510, SEQ ID NO:513, SEQ ID NO:516, SEQ ID NO:519, SEQ ID NO:522, SEQ ID NO:525, SEQ ID NO:528, SEQ ID NO:531 and SEQ ID NO:638.

In yet another aspect, a dAb comprises the amino acid sequence selected from the group consisting of SEQ ID NO:58, SEQ ID NO:59, SEQ ID NO:60, SEQ ID NO:61, SEQ ID NO:62, SEQ ID NO:63, SEQ ID NO:64, SEQ ID NO:65, SEQ ID NO:66, SEQ ID NO:67, SEQ ID NO:68, SEQ ID NO:272, SEQ ID NO:273, SEQ ID NO:274, SEQ ID NO:275, SEQ ID NO:276, SEQ ID NO:472, SEQ ID NO:473, SEQ ID NO:474, SEQ ID NO:475, SEQ ID NO:476, SEQ ID NO:477, SEQ ID NO:478, SEQ ID NO:479, SEQ ID NO:480, SEQ ID NO:481, SEQ ID NO:482, SEQ ID NO:483, SEQ ID NO:534, SEQ ID NO:535, SEQ ID NO:536, SEQ ID NO:537, SEQ ID NO:539, SEQ ID NO:540, SEQ ID NO:542, SEQ ID NO:543, SEQ ID NO:545, SEQ ID NO:547, SEQ ID NO:548, SEQ ID NO:550, SEQ ID NO:551, SEQ ID NO:553, SEQ ID NO:562, SEQ ID NO:567, SEQ ID NO:570, SEQ ID NO:575, SEQ ID NO:576, SEQ ID NO:577, SEQ ID NO:578, SEQ ID NO:580, SEQ ID NO:599, SEQ ID NO:600, SEQ ID NO:607, SEQ ID NO:611, SEQ ID NO:617, and SEQ ID NO:622. In an embodiment, a dAb comprises an amino acid sequence that differs from that of SEQ ID NO:58, SEQ ID NO:59, SEQ ID NO:60, SEQ ID NO:61, SEQ ID NO:62, SEQ ID NO:63, SEQ ID NO:64, SEQ ID NO:65, SEQ ID NO:66, SEQ ID NO:67, SEQ ID NO:68, SEQ ID NO:272, SEQ ID NO:273, SEQ ID NO:274, SEQ ID NO:275, SEQ ID NO:276, SEQ ID NO:534, SEQ ID NO:535, SEQ ID NO:536, SEQ ID NO:537, SEQ ID NO:539, SEQ ID NO:540, SEQ ID NO:542, SEQ ID NO:543, SEQ ID NO:545, SEQ ID NO:547, SEQ ID NO:548, SEQ ID NO:550, SEQ ID NO:551, SEQ ID NO:553, SEQ ID NO:562, SEQ ID NO:567, SEQ ID NO:570, SEQ ID NO:575, SEQ ID NO:576, SEQ ID NO:577, SEQ ID NO:578, SEQ ID NO:580, SEQ ID NO:599, SEQ ID NO:600, SEQ ID NO:607, SEQ ID NO:611, SEQ ID NO:617, or SEQ ID NO:622 by no more than 25 amino acids.

The dAb may inhibit binding of CD28 to CD80 and/or CD86 with an $IC_{50}$ of about 100 nM, about 50 nM, about 1 nM, about 500 pM, about 100 pM, about 50 pM, about 10 pM, about 5 pM, or about 1 pM. For example, the domain antibody inhibits binding of CD28 to CD80 with an $IC_{50}$ in the range of 1 pM to 1.5 pM, inclusive; $IC_{50}$ for inhibition of CD28 binding to CD80. The $IC_{50}$ can be in the range of 1 pM to 1 µM, 1 pM to 900 nM, 1 pM to 800 nM, 1 pM to 700 nM, 1 pM to 600 nM, 1 pM to 500 nM, 1 pM to 400 nM, 1 pM to 300 nM, 1 pM to 200 nM, 1 pM to 100 nM, 1 pM to 50 nM, 1 pM to 10 nM, 1 pM to 1 nM, 1 pM to 500 pM, 1 pM to 100 pM, 1 pM to 50 pM, 1 pM to 10 pM, or 1 pM to 5 pM. Further acceptable ranges include, for example, 50 pM to 1 µM, 100 pM to 500 nM, 125 pM to 250 nM, 150 pM to 200 nM, 150 pM to 100 nM, and 200 pM to 50 nM.

In another embodiment, the domain antibody inhibits binding of CD28 to CD86 with an $IC_{50}$ in the range of 1 pM to 1.5 pM, inclusive; $IC_{50}$ for inhibition of CD28 binding to CD86. The $IC_{50}$ can be in the range of 1 pM to 1 µM, 1 pM to 900 nM, 1 pM to 800 nM, 1 pM to 700 nM, 1 pM to 600 nM, 1 pM to 500 nM, 1 pM to 400 nM, 1 pM to 300 nM, 1 pM to 200 nM, 1 pM to 100 nM, 1 pM to 50 nM, 1 pM to 10 nM, 1 pM to 1 nM, 1 pM to 500 pM, 1 pM to 100 pM, 1 pM to 50 pM, 1 pM to 10 pM, or 1 pM to 5 pM. Further acceptable ranges include, for example, 50 pM to 1 µM, 100 pM to 500 nM, 125 pM to 250 nM, 150 pM to 200 nM, 150 pM to 100 nM, and 200 pM to 50 nM.

A method of antagonizing the binding of CD80 to CD28 in an individual is provided for, the method comprising administering a domain antibody as described herein to the individual, wherein the domain antibody antagonizes the binding of CD80 to CD28 in the individual. A method of antagonizing the binding of CD86 to CD28 in an individual comprises administering a domain antibody as described herein to the individual, wherein the domain antibody antagonizes the binding of CD86 to CD28 in the individual. A method of antagonizing an activity of CD28 in an individual comprises administering a domain antibody as described herein to the individual, wherein the domain antibody antagonizes an activity of CD28. A method of treating or preventing a disease or disorder mediated by CD28 in an individual in need of such treatment comprises administering to the individual a therapeutically effective amount of a composition comprising a domain antibody that binds CD28. In one embodiment, the disease or disorder is an autoimmune disease or disorder. In another embodiment, the disease or disorder is graft-related.

Also included is a dual specific ligand comprising a domain antibody having a binding specificity to a first antigen and a single variable domain having a binding activity to a second antigen, wherein the first antigen is CD28, and wherein binding of the single variable domain to the second antigen acts to increase the half-life of the ligand in vivo.

In one embodiment, the dual specific ligand is a four chain IgG immunoglobulin. The four chain IgG may comprise two dual specific ligands, said dual specific ligands being different in their variable domains.

In another embodiment, the domain antibodies are camelid $V_{HH}$ domains. In this embodiment of the dual specific ligand, the single immunoglobulin variable domain may be a heavy chain variable domain. In another embodiment of the dual specific ligand, the single immunoglobulin variable domain is a light chain variable domain. In one embodiment of the dual specific ligand, the ligand is provided as an IgG immunoglobulin comprising four heavy chain single variable domains or four light chain single variable domains. The heavy chain can comprise camelid $V_{HH}$ domains. In a further embodiment of the dual specific ligand, the first and second domains bind independently, such that the dual specific ligand may simultaneously bind both the first and second antigens. In one embodiment of the dual specific ligand, the domain antibody has a dissociation constant $(K_d)$ of $1 \times 10^{-8}$ M or less for human CD28, and a $K_{off}$ rate constant of $1 \times 10^{-3}$ s$^{-1}$ or less, as determined by surface plasmon resonance.

In one embodiment of the dual specific ligand, the single variable domain is specific for serum albumin (SA) and has a dissociation constant ($K_d$) of 1 nM to 500 µm for SA, as determined by surface plasmon resonance. In a further embodiment, the single variable domain binds SA in a standard ligand binding assay with an $IC_{50}$ of 1 nM to 500 µM. The single variable domain may be specific for SA, and comprise the amino acid sequence of MSA-16 or a sequence that is at least 80% identical thereto. Alternatively, the single variable domain may be specific for SA, and comprise the amino acid sequence of MSA-26 or a sequence that is at last 80% identical thereto.

In a further embodiment, the domain antibody can comprise a binding site for a generic ligand. In one embodiment, the generic ligand binding site is selected from the group consisting of protein A, protein L and protein G binding site.

In one embodiment of the dual specific ligand, the domain antibody comprises a universal framework. The domain antibody may also comprise a $V_H$ framework selected from the group consisting of DP47, DP45 and DP38; or a $V_L$ framework which is DPK9. The domain antibody may comprise one or more framework regions comprising an amino acid sequence that is the same as the amino acid sequence of a corresponding framework region encoded by a human germline antibody gene segment, or the amino acid sequence of one or more of said framework regions collectively comprises up to 5 amino acid differences relative to the amino acid sequence of said corresponding framework region encoded by a human germline antibody gene segment.

In one embodiment, the amino acid sequences of FW1, FW2, FW3, and FW4 of the domain antibody are the same as the amino acid sequences of corresponding framework regions encoded by a human germline antibody gene segment, or the amino acid sequences of FW1, FW2, FW3, and FW4 collectively contain up to 10 amino acid differences relative to the amino acid sequences of corresponding framework regions encoded by said human germline antibody gene segment.

In one embodiment, the amino acid sequences of said FW1, FW2, and FW3 of the domain antibody are the same as the amino acid sequences of corresponding framework regions encoded by human germline antibody gene segments. The human germline antibody gene segments may be selected from the group consisting of DP47, DP45, DP48, and DPK9.

Also included is a method for producing a dual specific ligand as described herein, comprising a domain antibody having a binding specificity for CD28 and a single domain antibody having a binding specificity for a protein which increases the half-life of the ligand in vivo, the method comprising the steps of: selecting a first variable domain by its ability to bind CD28; selecting a second variable domain by its ability to bind to said protein which increases the half-life of the ligand in vivo; combining the variable domains; and selecting the dual specific ligand by its ability to bind to CD28 and said protein. In one embodiment, the domain antibody is selected for binding to CD28 in absence of a complementary variable domain.

Also included is nucleic acid encoding a dual specific ligand described herein. The nucleic acid may comprise the nucleic acid sequence of MSA-16 or a sequence that is at least 80% identical thereto, or alternatively may comprise, the nucleic acid sequence of MSA-26 or a sequence that is at least 70% identical thereto. The nucleic acid may be incorporated into a vector, which may be incorporated into a host cell.

Also included is a pharmaceutical composition comprising a dual specific ligand as described herein and a pharmaceutically acceptable excipient, carrier, or diluent.

Also included is a dual specific ligand comprising first and second heavy chain single variable domains, or first and second light chain single variable domains, wherein the first variable domain is a domain antibody. In one embodiment, the second variable domain has binding specificity for an antigen other than CD28. In an aspect, the second variable domain contributes to and/or enhances the stability of a domain antibody. By way of a non-limiting example, the second variable domain has binding specificity serum albumin.

Also included is a dual specific ligand comprising a first single variable domain having a binding specificity to a first antigen and a second single variable domain having a binding activity to a second antigen, wherein the first antigen is CD28 and the second antigen is an antigen presenting cell surface antigen or a T cell surface antigen. The antigen presenting cell surface antigen can be selected from one of the group consisting of dendritic cell surface antigens, activated macrophage surface antigens, activated B cell surface antigens, co-stimulatory signal pathway surface antigens, and MHC antigens. In one embodiment, the MHC antigen is a MHC class II antigen, and the class II antigen can be the alpha and/or beta chain.

The antigen presenting cell surface antigen or a T cell surface antigen may be selected from the group consisting of CD40, CD40L, Inducible co-stimulatory molecule (ICOS), CD27, CD30, OX40, CD45, CD69, CD3, CD70, inducible co-stimulatory molecule ligand (ICOSL), OX40L, CD80, CD86, HVEM (Herpes Virus Entry Mediator), and LIGHT, including one of CD40L, Inducible co-stimulatory molecule (ICOS), CD27, CD30, OX40, CD45, CD69, or CD3. An exemplary surface antigen is a B7 gene surface antigen such as CD86 or CD80.

In another embodiment, a dual specific ligand comprises a first domain antibody having a binding specificity for a first antigen and a second single variable domain having a binding activity to a second antigen, wherein the first antigen is CD28 and the second antigen is a cytokine. In particular embodiments, the cytokine may be GM-CSF, IL-1α, IL-1β, IL-2, IL-3, IL-4, IL-5, IL-6, IL-8, IL-10, IL-11 IL-12 IL-13, IL-15, IL-17, IL-18, IL-21, IL-22, IL-23, IL-24, IL-28, IL-33, LIF, TGFβ, TNF-α, TNF-β, IFN-α, IFN-β, IFN-γ.

Domain antibodies as described herein also may be administered in combination with additional immunosuppressive/immunomodulatory and/or anti-inflammatory agents or therapies, such as a calcineuirin inhibitor, cyclosporine, cytoxan, prednisone, azathioprine, methotrexate, corticosteroids, nonsteroidal antiinflammatory drugs/Cox-2 inhibitors, hydroxychloroquine, sulphasalazopryine, gold salts, etanercept, infliximab, anakinra, mizoribine, mycophenolic acid, mycophenolate mofetil, interferon beta-1a, interferon beta-1b, glatiramer acetate, mitoxantrone hydrochloride, and/or other biologics like anti-TNF. The domain antibodies also may be administered in combination with one or more of the following agents to regulate an immune response: CTLA4, soluble gp39 (also known as CD40 ligand (CD40L), CD154, T-BAM, TRAP), soluble CD29, soluble CD40, soluble CD80, soluble CD86, soluble CD56, soluble Thy-1, soluble CD3, soluble TCR, soluble VLA-4, soluble VCAM-1, soluble LECAM-1, soluble ELAM-1, soluble CD44, antibodies reactive with gp39, antibodies reactive with CD40, antibodies reactive with B7, antibodies reactive with CD28, antibodies reactive with LFA-1, antibodies reactive with LFA-2, antibodies reactive with IL-2, antibodies reactive with IL-12, antibodies reactive with IFN-gamma, antibodies reactive with CD2, antibodies reactive with CD48, antibodies reactive with any ICAM (e.g., ICAM-2), antibodies reactive with CTLA4, antibodies reactive with Thy-1, antibodies reactive with CD56, antibodies reactive with CD3, antibodies reactive with CD29, antibodies reactive with TCR, antibodies reactive with VLA-4, antibodies reactive with VCAM-1, antibodies reactive with LECAM-1, antibodies reactive with ELAM-1, antibodies reactive with CD44, monoclonal antibodies to leukocyte receptors, e.g., MHC, CD2, CD3, CD4, CD11a/CD18, CD7, CD25, CD 27, B7, CD40, CD45, CD58, CD 137, ICOS, CD150 (SLAM), OX40, 4-1BB or their ligands. The determination of the optimal combination and dosages can be determined and optimized using methods well known in the art.

Where domain antibodies of the invention are administered "in combination with" another immunosuppressive/immunomodulatory or anti-inflammatory agent or therapy, e.g., as specified above, the administration may be made concomitantly or in sequence. When the dAbs are administered concomitantly with another agent, such as an agent specified above, the dAb and agent may administered in the same pharmaceutical composition.

In an embodiment, a domain antibody is provided for the preparation of a medicament for the treatment of a patient, wherein the patient is in need of a CD28-binding domain antibody. In one embodiment, the patient is afflicted with an immune disease.

In one aspect, the immune disease is an autoimmune disease. An autoimmune disease includes, but is not limited to, Addison's disease, allergy, allergic rhinitis, ankylosing spondylitis, asthma, atherosclerosis, autoimmune diseases of the ear, autoimmune diseases of the eye, autoimmune atrophic gastritis, autoimmune hepatitis, autoimmune hymolytic anemia, autoimmune parotitis, autoimmune uveitis, celiac disease, primary biliary cirrhosis, benign lymphocytic aniitis, COPD, colitis, coronary heart disease, Crohn's disease, diabetes (Type I), depression, diabetes, including Type 1 and/or Type 2 diabetes, epididymitis, glomerulonephritis, Goodpasture's syndrome, Graves' disease, Guillain-Barre syndrome, Hashimoto's disease, hemolytic anemia, idiopathic thrombocytopenic purpura, inflammatory bowel disease (IBD), immune response to recombinant drug products, e.g., factor VII in hemophilia, juvenile idiopathic arthritis, systemic lupus erythematosus, lupus nephritis, male infertility, mixed connective tissue disease, multiple sclerosis, myasthenia gravis, oncology, osteoarthritis, pain, primary myxedema, pemphigus, pernicious anemia, polymyositis, psoriasis, psoriatic arthritis, reactive arthritis, rheumatic fever, rheumatoid arthritis, sarcoidosis, scleroderma, Sjogren's syndrome, spondyloarthropathies, sympathetic ophthalmia, T-cell lymphoma, T-cell acute lymphoblastic leukemia, testicular antiocentric T-cell lymphoma, thyroiditis, transplant rejection, ulcerative colitis, autoimmune uveitis, and vasculitis. Autoimmune diseases include, but are not limited to, conditions in which the tissue affected is the primary target, and in some cases, the secondary target. Such conditions include, but are not limited to, AIDS, atopic allergy, bronchial asthma, eczema, leprosy, schizophrenia, inherited depression, transplantation of tissues and organs, chronic fatigue syndrome, Alzheimer's disease, Parkinson's disease, myocardial infarction, stroke, autism, epilepsy, Arthus's phenomenon, anaphylaxis, and alcohol and drug addiction.

In another aspect, the immune disease is a graft-related disease, such as allograft rejection, xenograft rejection graft versus host disease (GVHD), acute transplantation rejection, and chronic transplantation rejection.

Included is a dAb that has at least three characteristics selected from the group consisting of:
a) prevents CD80 and CD86 binding to CD28,
b) does not agonize CD28 signaling in combination with T cell receptor signaling,
c) has a Kd of about 50 nM to about 1 pM for binding to CD28,
d) has a tα half-life of about 15 seconds to about 12 hours.
e) has a tβ half-life of about 12 hours to about 336 hours,
f) binds a MYPPPY sequence, and
g) a CDR1 sequence selected from the group consisting of SEQ ID NO:484, SEQ ID NO:487, SEQ ID NO:490, SEQ ID NO:493, SEQ ID NO:496, SEQ ID NO:499, SEQ ID NO:502, SEQ ID NO:505, SEQ ID NO:508, SEQ ID NO:511, SEQ ID NO:514, SEQ ID NO:517, SEQ ID NO:520, SEQ ID NO:523, SEQ ID NO:526, SEQ ID NO:529 and SEQ ID NO:636; a CDR2 sequence selected from the group consisting of SEQ ID NO:485, SEQ ID NO:488, SEQ ID NO:491, SEQ ID NO:494, SEQ ID NO:497, SEQ ID NO:500, SEQ ID NO:503, SEQ ID NO:506, SEQ ID NO:509, SEQ ID NO:512, SEQ ID NO:515, SEQ ID NO:518, SEQ ID NO:521, SEQ ID NO:524, SEQ ID NO:527, SEQ ID NO:530 and SEQ ID NO:637; and a CDR3 sequence selected from the group consisting of SEQ ID NO:486, SEQ ID NO:489, SEQ ID NO:492, SEQ ID NO:495, SEQ ID NO:498, SEQ ID NO:501, SEQ ID NO:504, SEQ ID NO:507, SEQ ID NO:510, SEQ ID NO:513, SEQ ID NO:516, SEQ ID NO:519, SEQ ID NO:522, SEQ ID NO:525, SEQ ID NO:528, SEQ ID NO:531 and SEQ ID NO:638.

Also included is a nucleic acid encoding the dAbs disclosed herein.

Included is method of antagonizing CD28, comprising administering an effective amount of a dAb disclosed herein to an individual. Also included is a method of antagonizing the binding of CD28 comprising administering an effective amount of the dAb disclosed herein to an individual, wherein the dAb antagonizes the binding of CD28 to CD80 and/or CD86 in the individual.

Further included is a method of treating, alleviating, or preventing a symptom of an immune disease, such as an autoimmune disease or a graft-related disease, comprising administering an effective amount of a dAb disclosed herein to an individual having or at risk of having an immune disease. Included is a method of treating, alleviating, or preventing an immune disease, comprising administering an effective amount of a dAb disclosed herein to an individual having or at risk of having an immune disease.

Included herein is a pharmaceutical composition comprising a therapeutically-effective amount of a dAb disclosed herein and a pharmaceutically acceptable carrier.

Included is the use of a dAb disclosed herein for preparing a medicament for treating or preventing an immune disease in a patient in need thereof. Also included is the use of a dAb disclosed herein for preparing a medicament for treating or preventing a symptom of an immune disease in a patient in need thereof. Further included herein is the use of a dAb disclosed herein for preparing a medicament for alleviating at least one symptom of an immune disease in a patient in need thereof.

BRIEF DESCRIPTION OF THE DRAWINGS

FIG. 1, comprising FIG. 1A illustrates that increasing concentrations of various dAbs do not activate CD28, while an anti-CD3 antibody (OKT3) control, added to PBMC, demonstrated activation of CD28. Domain antibodies (dAbs) and antibody were added to a 96-well plate that was seeded with PBMC isolated from whole blood of normal donors. FIG. 1B illustrates that dAbs, anti-CD28 (9.3), anti-CD3 (OKT3), or isotype control fixed to a 96-well round-bottom plate did not exhibit agonist activity in PBMC added to the wells.

FIG. 4, comprising FIG. 4A illustrates the receptor occupancy with intraperitoneal dosing of the dAb. FIG. 4B illustrates the receptor occupancy with subcutaneous dosing of the dAb.

FIG. 7 shows ELISAs of soluble monoclonal domain antibodies binding to recombinant human CD28/Fc Chimera and Fc control coated plates.

DETAILED DESCRIPTION

Figure 1A:
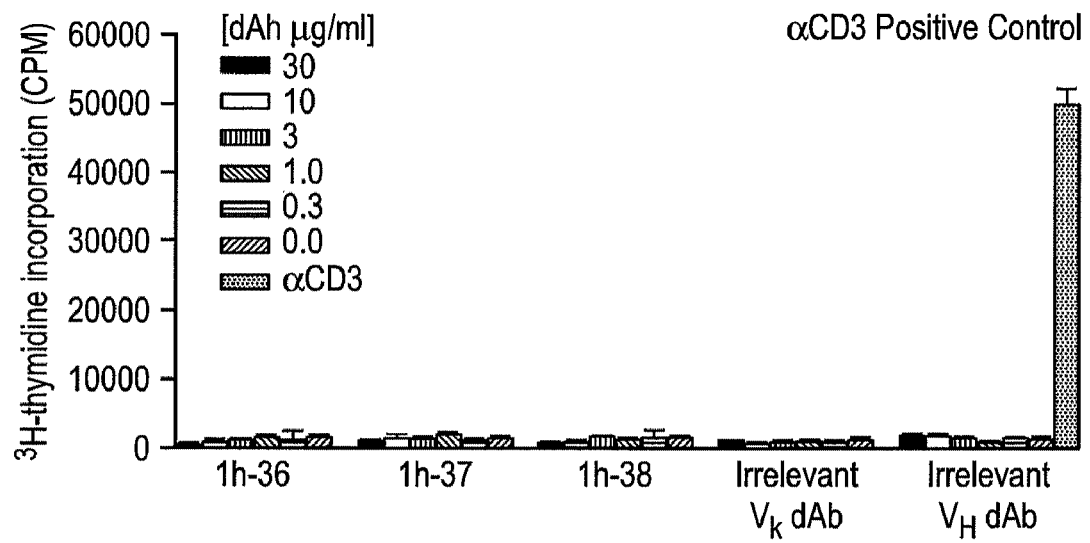
FIGS. 1A and 1B, is a series of images depicting that anti-human CD28 domain antibodies set forth herein do not exhibit agonist activity.

The present disclosure provides domain antibodies to antagonize CD28 activity. The domain antibodies may be linked to polymers to improve pharmacokinetic properties, such as stability and half-life. Included herein are compositions and methods for the attachment of polymer molecules (e.g., polyethylene glycol; PEG) to proteins to modulate the pharmacokinetic properties of the modified proteins. For example, PEG modification of proteins has been shown to alter the in vivo circulating half-life, antigenicity, solubility, and resistance to proteolysis of the protein (Abuchowski et al. (1977) *J. Biol. Chem.*, 252: 3578; Nucci et al. (1991) *Adv. Drug Delivery Reviews* 6: 133; Francis et al., *Pharmaceutical Biotechnology Vol.* 3 (Borchardt, R. T. ed.); and Stability of Protein Pharmaceuticals: in vivo Pathways of Degradation and Strategies for Protein Stabilization 1991 pp 235-263, Plenum, NY).

1. Definitions and Acronyms 1.1. Definitions

In accordance with this detailed description, the following abbreviations and definitions apply. It must be noted that as used herein, the singular forms "a", "an", and "the" include plural referents unless the context clearly dictates otherwise. Thus, for example, reference to "an antibody" includes a plurality of such antibodies and reference to "the dosage" includes reference to one or more dosages and equivalents thereof known to those skilled in the art, and so forth.

Unless defined otherwise, all technical and scientific terms used herein have the same meaning as commonly understood by one of ordinary skill in the art. Unless otherwise stated, all ranges described herein are inclusive of the specific endpoints. The following terms are provided below.

As used herein, the term "human" when applied to a domain antibody or to an immunoglobulin variable domain means that the polypeptide has a sequence derived from a human immunoglobulin. A sequence is "derived from" a human immunoglobulin coding sequence when the sequence is either: a) isolated from a human individual or from cells or a cell line from a human individual; b) isolated from a library of cloned human antibody gene sequences (or a library of human antibody V domain sequences); or c) when a cloned human antibody gene sequence (or a cloned human V region sequence (including, e.g., a germline V gene segment)) was used to generate one or more diversified sequences that were then selected for binding to a desired target antigen.

At a minimum, a human domain antibody has at least 70% identical, at least 75% identical, at least 80% identical, at least 85% amino acid identity (including, for example, 87%, 90%, 93%, 95%, 97%, 99%, or higher identity) to a naturally-occurring human immunoglobulin variable domain sequence, e.g., a naturally-occurring human immunoglobulin variable domain sequence disclosed in Kabat ("Sequences of Proteins of Immunological Interest", US Department of Health and Human Services 1991).

As used herein, the term "domain" refers to a folded protein structure which retains its tertiary structure independently of the rest of the protein. Generally, domains are responsible for discrete functional properties of proteins, and in many cases may be added, removed, or transferred to other proteins without loss of function of the remainder of the protein and/or of the domain.

By "domain antibody" is meant a folded polypeptide domain which comprises a sequence characteristic of immunoglobulin variable domains and which specifically binds an antigen (e.g., dissociation constant of 500 nM or less). A "domain antibody" therefore includes complete antibody variable domains as well as modified variable domains, for example in which one or more loops have been replaced by sequences which are not characteristic of antibody variable domains, or antibody variable domains which have been truncated or comprise N- or C-terminal extensions, as well as folded fragments of variable domains which retain a dissociation constant of 500 nM or less (e.g., 450 nM or less, 400 nM or less, 350 nM or less, 300 nM or less, 250 nM or less, 200 nM or less, 150 nM or less, 100 nM or less) and the target antigen specificity of the full-length domain. Where necessary or in case of any doubt, the numbering convention and boundaries set forth by Kabat et al. (Kabat et al. (1991) *Sequences of Immunological Interest*, 5$^{th}$ ed. U.S. Dept. Health & Human Services, Washington, D.C.) are applicable to immunoglobulin variable and constant domains referred to herein.

A "dAb" is used interchangeably with "domain antibody" herein.

A domain antibody, as used herein, refers to a mammalian immunoglobulin polypeptide, including human, but also includes rodent (for example, as disclosed in WO00/29004, the contents of which are incorporated herein in their entirety) or camelid $V_{HH}$ dAbs. Camelid dAbs are antibody single variable domain polypeptides which are derived from species including camel, llama, alpaca, dromedary, and guanaco, and comprise heavy chain antibodies naturally devoid of light chain: $V_{HH}$. $V_{HH}$ molecules are about 10× smaller than IgG molecules, and as single polypeptides, they are very stable, resisting extreme pH and temperature conditions.

Camelid antibodies are described in, for example, U.S. Pat. Nos. 5,759,808; 5,800,988; 5,840,526; 5,874,541; 6,005,079; and 6,015,695, the contents of each of which are incorporated herein in their entirety. Humanized camelid $V_{HH}$ polypeptides are taught, for example in WO04/041862, the teachings of which are incorporated herein in their entirety. It will be understood by one of skill in the art that naturally occurring camelid antibody single variable domain polypeptides may be modified according to the teachings of WO04/041862 (e.g., amino acid substitutions at positions 45 and 103) to generate humanized camelid $V_{HH}$ polypeptides. Also included herein are antibody single variable domain polypeptides which are nurse shark $V_{HH}$. Nurse Shark $V_{HH}$ dAbs are described, for example, in Greenberg et al. (1995) Nature 374: 168-173 and U.S. Publication No. 20050043519.

As used herein, the phrase "sequence characteristic of immunoglobulin variable domains" refers to an amino acid sequence that is identical, over 20 or more, 25 or more, 30 or more, 35 or more, 40 or more, 45 or more, or even 50 or more contiguous amino acids, to a sequence comprised by an immunoglobulin variable domain sequence.

Sequences similar or identical (e.g., at least about 70% sequence identity) to the sequences disclosed herein are also included herein. In some embodiments, the sequence identity at the amino acid level can be about 70%, 75%, 80%, 85%, 90%, 91%, 92%, 93%, 94%, 95%, 96%, 97%, 98%, 99%, or higher. At the nucleic acid level, the sequence identity can be about 50%, 55%, 60%, 65%, 70%, 75%, 80%, 85%, 90%, 91%, 92%, 93%, 94%, 95%, 96%, 97%, 98%, 99%, or higher. Alternatively, substantial identity exists when the nucleic acid segments will hybridize under selective hybridization conditions (e.g., very high stringency hybridization conditions), to the complement of the strand. The nucleic acids may be present in whole cells, in a cell lysate, or in a partially purified or substantially pure form.

As used herein, the term "identity" refer to the degree with which two nucleotide or amino acid sequences structurally resemble each other. As used herein, sequence "similarity" is a measure of the degree to which amino acid sequences share similar amino acid residues at corresponding positions in an alignment of the sequences. Amino acids are similar to each other where their side chains are similar. Specifically, "similarity" encompasses amino acids that are conservative substitutes for each other. A "conservative" substitution is any substitution that has a positive score in the blosum62 substitution matrix (Hentikoff and Hentikoff (1992) Proc. Natl. Acad. Sci. USA 89: 10915-10919). By the statement "sequence A is n % similar to sequence B" is meant that n % of the positions of an optimal global alignment between sequences A and B consists of identical amino acids or conservative substitutions. As used herein, two sequences are "similar" to each other, or share a "percent identity", when aligned using either the Needleman-Wunsch algorithm or the "BLAST 2 sequences" algorithm described by Tatusova & Madden (1999) FEMS Microbiol Lett. 174: 247-250. Where amino acid sequences are aligned using the "BLAST 2 sequences algorithm," the Blosum 62 matrix is the default matrix. Optimal global alignments can be performed using the following parameters in the Needleman-Wunsch alignment algorithm:

For polypeptides:
    Substitution matrix: blosum62.
        Gap scoring function: −A −B*LG, where A=11
            (the gap penalty), B=1 (the gap length penalty)
            and LG is the length of the gap.
For nucleotide sequences:
    Substitution matrix: 10 for matches, 0 for mismatches.
        Gap scoring function: −A −B*LG where A=50 (the gap penalty),
            B=3 (the gap length penalty) and LG is the length of the gap.

Using the software AlignX, a component of Vector NTI Suite 8.0 (InforMax, Inc.), the alignment was created using the Clustal W algorithm (1994) Nucleic Acid Research, 22 (22): 4673-4680. In using this method, a crude similarity between all pairs of sequences is calculated, called a "Parities alignment." These scores are then used to calculate a "guide tree" or dendrogram, which tells the multiple alignment stage the order in which to align the sequences for the final multiple alignment. Having calculated the dendrogram, the sequences are aligned in larger and larger groups until the entire sequences are incorporated in the final alignment.

Alternatively, calculations of identity of amino acid and nucleic acid sequences are determined herein using the software AlignX, with the following parameters:

| | |
|---|---|
| Use FAST Algorithm: | OFF |
| K-tuple size: | 1 |
| Number of best diagonals: | 5 |
| Window Size: | 5 |
| Gap penalty: | 3 |
| Gap opening penalty: | 10 |
| Gap extension penalty: | 0.1 |

Multiple Alignment Settings for AlignX were set as follows:

| | |
|---|---|
| Gap opening penalty: | 10 |
| Gap extension penalty: | 0.05 |
| Gap separation penalty range: | 8 |
| No end gap separation penalty: | Unselected |
| % identity for alignment delay: | 40 |
| Residue specific gaps off: | Unselected |
| Hydrophilic residue gap off: | Unselected |
| Transition weighting: | 0 |

Typical conservative substitutions are exchanges among Met, Val, Leu, and Ile; among Ser and Thr; among the residues Asp, Glu, and Asn; among the residues Gln, Lys, and Arg; or aromatic residues Phe and Tyr.

As used herein, the term "epitope" refers to a unit of structure conventionally bound by an immunoglobulin $V_H/V_L$ pair. Epitopes define the minimum binding site for an antibody, and thus represent the target of specificity of an antibody. In the case of a domain antibody, an epitope represents the unit of structure bound by a domain antibody in isolation. That is, the binding site is provided by one, single immunoglobulin variable domain. Epitopes can be linear or conformational, and can be as small as three amino acids.

As used herein, the term "extended release", or the equivalent terms "controlled release" or "slow release", refer to drug formulations that release active drug, such as a polypeptide drug, over a period of time following administration to an individual. Extended release of polypeptide drugs, which can occur over a range of desired times, e.g., minutes, hours, days, weeks, or longer, depending upon the drug formulation, is in contrast to standard formulations in which substantially the entire dosage unit is available for immediate absorption or immediate distribution via the bloodstream. Extended release formulations may result in a level of circulating drug from a single administration that is sustained, for example, for 8 hours or more, 12 hours or more, 24 hours or more, 36 hours or more, 48 hours or more, 60 hours or more, 72 hours or more 84 hours or more, 96 hours or more, or even, for example, for 1 week or 2 weeks or more, for example, 1 month or more.

As used herein, "CD28 activity" is an activity involving or resulting from the binding of CD80, CD86 and/or another ligand to CD28, and includes, but is not limited to, activation of CD28-mediated cell signaling. CD28 activity also includes the induction of T cell proliferation and the induction of cytokine secretion, e.g., interleukin 2 (IL-2), by T cells.

As used herein, the term "does not substantially agonize" means that a given agent, e.g., a domain antibody, does not substantially activate one or more of the CD28 activities as the term "activate" is defined herein. Specifically, an agent that "does not substantially agonize" means that the agent does not activate more than 20% of the activity which is activated by CD80 and/or CD86 binding to CD28, and in an aspect, the agent does not activate more than about 10%, 8%, 5%, 3%, or 2% or less, including zero activation, of the activity which is activated by CD80 and/or CD86 binding to CD28. By way of a non-limiting example, a domain antibody set forth herein that does not substantially agonize CD28 activity does not agonize CD28 activity more than 5% of the activity obtained upon agonism of CD28 activity by anti-CD28 mAb 9.3 (Gibson, et al. (1996) *JBC*, 271: 7079-7083) under otherwise identical assay conditions.

As used herein, the terms "inhibit," "inhibits" and "inhibited" refer to a decrease in a given measurable activity (e.g., binding activity) by at least 10% relative to a reference. Where inhibition is desired, such inhibition is at least about 20%, 30%, 40%, 50%, 60%, 70%, 80%, 90%, or more, up to and including 100%, i.e., complete inhibition or absence of the given activity. Inhibition of CD28 binding to CD80 or CD86 can be measured as described in the working examples herein. As used herein, the term "substantially inhibits" refers to a decrease in a given measurable activity (e.g., the binding of CD28 to CD80 or CD86) by at least 50% relative to a reference. For example, "substantially inhibits" refers to a decrease in a given measurable activity of at least about 50%, 55%, 60%, 65%, 70%, 75%, 80%, 85%, 90%, 95%, and up to and including 100% relative to a reference. As used herein, "inhibits the binding", with reference to the binding of a domain antibody binding to CD28, or CD80 binding to CD28, or CD86 binding to CD28, refers to a decrease in binding by at least 10% relative to a reference. "Inhibits the binding" refers to a decrease in binding of at least about 20%, 30%, 40%, 50%, 60%, 70%, 80%, 90%, or more, up to and including 100%.

As used herein, the terms "activate," "activates" and "activated" refer to an increase in a given measurable activity by at least 5% relative to a reference, for example, at least 10%, 25%, 50%, 75%, or even 100%, or more.

As used herein, the term "CD28 antagonist" refers to an agent that inhibits at least one activity mediated by CD28, by inhibiting the binding of CD80 and/or CD86 to CD28. A CD28 activity is "antagonized" if the activity is reduced by at least 10%, and in an exemplary embodiment, at least about 20%, 30%, 40%, 50%, 60%, 70%, 80%, 90%, 95%, 97%, or even 100% (i.e., no activity) in the presence, relative to the absence of an antagonist. In an exemplary embodiment, a CD28 antagonist as the term is used herein comprises a domain antibody that binds monovalently to CD28. By way of a non-limiting example, a CD28 antagonist as set forth herein is an agent that inhibits some or all CD28 activity, while at the same time, the agent does not substantially agonize CD28 activity in combination with T cell receptor signaling.

As used herein, the term "preferentially inhibits" as used in a phrase such as "wherein a domain antibody preferentially inhibits the binding to CD28 by CD86 relative to the binding to CD28 by CD80", means that the domain antibody effects a higher amount of inhibition of CD86 binding to CD28 as defined above, relative to the amount of inhibition of CD80 binding to CD28 as defined above.

As used herein, the term "CD28 agonist" refers to an agent that activates at least one activity mediated by CD28, either alone or when combined with another co-stimulus, relative to a reference. An activity is "agonized" if the activity is increased by at least about 10%, e.g., 50%, in the presence, relative to the absence of an agonist.

As used herein, the inhibiting "CTLA4 activity" includes, but is not limited to, inhibition of T cell function. Such functions include, among others, T cell receptor mediated signaling, T cell proliferation, and induction of cytokine secretion.

As used herein, "immune disease" refers to any disease which is associated with the development of an immune reaction in an individual, including a cellular and/or a humeral immune reaction. Examples of immune diseases include, but are not limited to, inflammation, allergy, autoimmune diseases, and graft-related diseases.

As used herein, "autoimmune disease" refers to disease conditions and states wherein the immune response of an individual is directed against the individual's own constituents, resulting in an undesirable and often debilitating condition. As used herein, "autoimmune disease" is intended to further include autoimmune conditions, syndromes, and the like. Autoimmune diseases include, but are not limited to, Addison's disease, allergy, allergic rhinitis, ankylosing spondylitis, asthma, atherosclerosis, autoimmune diseases of the ear, autoimmune diseases of the eye, autoimmune atrophic gastritis, autoimmune hepatitis, autoimmune hymolytic anemia, autoimmune parotitis, autoimmune uveitis, celiac disease, primary biliary cirrhosis, benign lymphocytic aniitis, COPD, colitis, coronary heart disease, Crohn's disease, diabetes (Type I), depression, diabetes, including Type 1 and/or Type 2 diabetes, epididymitis, glomerulonephritis, Goodpasture's syndrome, Graves' disease, Guillain-Barre syndrome, Hashimoto's disease, hemolytic anemia, idiopathic thrombocytopenic purpura, inflammatory bowel disease (IBD), immune response to recombinant drug products, e.g., factor VII in hemophilia, juvenile idiopathic arthritis, systemic lupus erythematosus, lupus nephritis, male infertility, mixed connective tissue disease, multiple sclerosis, myasthenia gravis, oncology, osteoarthritis, pain, primary myxedema, pemphigus, pernicious anemia, polymyositis, psoriasis, psoriatic arthritis, reactive arthritis, rheumatic fever, rheumatoid arthritis, sarcoidosis, scleroderma, Sjogren's syndrome, spondyloarthropathies, sympathetic ophthalmia, T-cell lymphoma, T-cell acute lymphoblastic leukemia, testicular antiocentric T-cell lymphoma, thyroiditis, transplant rejection, ulcerative colitis, autoimmune uveitis, and vasculitis. Autoimmune diseases include, but are not limited to, conditions in which the tissue affected is the primary target, and in some cases, the secondary target. Such conditions include, but are not limited to, AIDS, atopic allergy, bronchial asthma, eczema, leprosy, schizophrenia, inherited depression, transplantation of tissues and organs, chronic fatigue syndrome, Alzheimer's disease, Parkinson's disease, myocardial infarction, stroke, autism, epilepsy, Arthus's phenomenon, anaphylaxis, and alcohol and drug addiction.

As used herein, the term "antibody polypeptide" refers to a polypeptide which either is an antibody or is a part of an antibody, modified or unmodified, which retains the ability to specifically bind antigen. Thus, the term antibody polypeptide includes an antigen-binding heavy chain, light chain, heavy chain-light chain dimer, Fab fragment, F(ab')$_2$ fragment, dAb, or an Fv fragment, including a single chain Fv (scFv). The phrase "antibody polypeptide" is intended to encompass recombinant fusion polypeptides that comprise an antibody polypeptide sequence that retains the ability to specifically bind antigen in the context of the fusion.

As used herein, the term "monovalent" means that a given domain antibody can bind only a single molecule of its target. Naturally-occurring antibodies are generally divalent, in that they have two functional antigen-binding loops, each comprising a VH and a VL domain. Where steric hindrance is not an issue, a divalent antibody can bind two separate molecules of the same antigen. In contrast, a "monovalent" antibody has the capacity to bind only one such antigen molecule. As the term is used herein, a "monovalent" antibody can also comprise more than one antigen binding site, e.g., two antigen binding sites, but the binding sites must be for different antigens, such that the antibody can only bind one molecule of CD28 at a time. The antigen-binding domain of a monovalent antibody can comprise a $V_H$ and a $V_L$ domain, but in an aspect, comprises only a single immunoglobulin variable domain, i.e., a $V_H$ or a $V_L$ domain, that has the capacity to bind CD28 without the need for a corresponding $V_L$ or $V_H$ domain, respectively. A monovalent antibody lacks the capacity to cross link molecules of a single antigen.

As used herein, the term "standard platelet aggregation assay" means the assay described in the section herein below, entitled "Platelet Aggregation Assay."

As used herein, the terms "$V_H$ domain" and "$V_L$ domain" refer to immunoglobulin variable regions as defined by Kabat et al. (Kabat et al. (1991) *Sequences of Immunological Interest*, 5$^{th}$ ed. U.S. Dept. Health & Human Services, Washington, D.C.), which is incorporated herein by reference.

As used herein, "linked" refers to the attachment of a polymer moiety, such as PEG to an amino acid residue of a domain antibody. Attachment of a PEG polymer to an amino acid residue of a domain antibody, e.g., a domain antibody, is referred to as "PEGylation" and may be achieved using several PEG attachment moieties including, but not limited to N-hydroxylsuccinimide (NHS) active ester, succinimidyl propionate (SPA), maleimide (MAL), vinyl sulfone (VS), or thiol. A PEG polymer, or other polymer, can be linked to a domain antibody at either a predetermined position, or may be randomly linked to the domain antibody molecule. The PEG polymer may be linked to a domain antibody at a predetermined position. A PEG polymer may be linked to any residue in a domain antibody, however, it is preferable that the polymer is linked to either a lysine or cysteine, which is either naturally occurring in the domain antibody or which has been engineered into the domain antibody, for example, by mutagenesis of a naturally occurring residue in the domain antibody to either a cysteine or lysine. PEG-linkage can also be mediated through a peptide linker attached to a domain antibody. That is, the PEG moiety can be attached to a peptide linker fused to a domain antibody, where the linker provides the site, e.g., a free cysteine or lysine, for PEG attachment. As used herein, "linked" can also refer to the association of two or more domain antibodies, e.g., dAb monomers, to form a dimer, trimer, tetramer, or other multimer. Domain antibody monomers can be linked to form a multimer by several methods known in the art, including, but not limited to, expression of the domain antibody monomers as a fusion protein, linkage of two or more monomers via a peptide linker between monomers, or by chemically joining monomers after translation, either to each other directly, or through a linker by disulfide bonds, or by linkage to a di-, tri- or multivalent linking moiety (e.g., a multi-arm PEG). While dAb multimers are specifically contemplated herein, e.g., in the context of dual- or multi-specific domain antibody constructs, it is emphasized that for any given domain antibody construct, the construct should only be able to bind one molecule of CD28, i.e., the constructs should have only one CD28-binding element, and should not cross link CD28.

As used herein, "polymer" refers to a macromolecule made up of repeating monomeric units, and can refer to a synthetic or naturally occurring polymer such as an optionally substituted straight or branched chain polyalkylene, polyalkenylene, or polyoxyalkylene polymer or a branched or unbranched polysaccharide. A "polymer" as used herein, specifically refers to an optionally substituted or branched chain poly(ethylene glycol), poly(propylene glycol), or poly(vinyl alcohol) and derivatives thereof.

As used herein, "PEG" or "PEG polymer" refers to polyethylene glycol, and more specifically can refer to a derivatized form of PEG, including, but not limited to N-hydroxylsuccinimide (NHS) active esters of PEG such as succinimidyl propionate, benzotriazole active esters, PEG derivatized with maleimide, vinyl sulfones, or thiol groups. For example, PEG formulations can include PEG-O—$CH_2CH_2CH_2$—$CO_2$—NHS; PEG-O—$CH_2$—NHS; PEG-O—$CH_2CH_2$—$CO_2$—NHS; PEG-S—$CH_2CH_2$—CO—NHS; PEG-O$_2$CNH—CH(R)—$CO_2$—NHS; PEG-NHCO—$CH_2CH_2$—CO—NHS; and PEG-O—$CH_2$—$CO_2$—NHS; where R is $(CH_2)_4)NHCO_2$(mPEG). PEG polymers set forth herein may be linear molecules, or may be branched wherein multiple PEG moieties are present in a single polymer. Some representative PEG conformations include, but are not limited to the following:

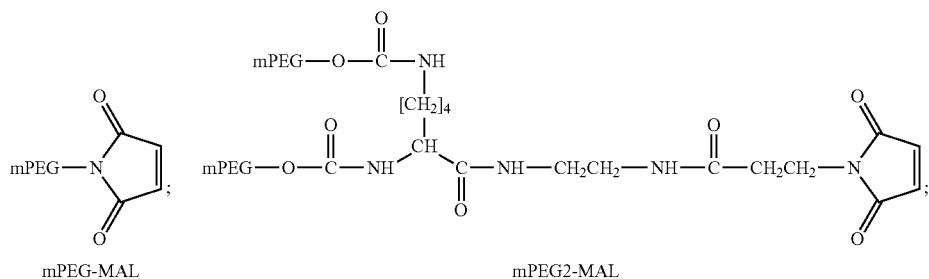
mPEG-MAL; mPEG2-MAL;
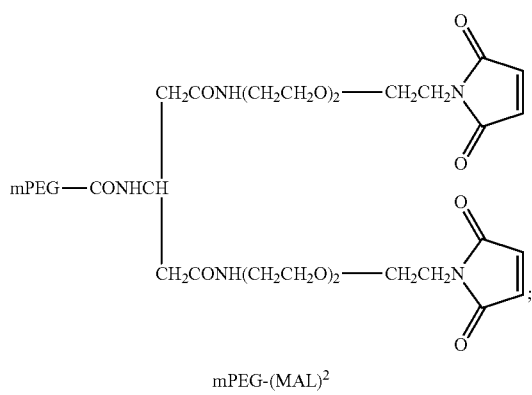
mPEG-(MAL)²
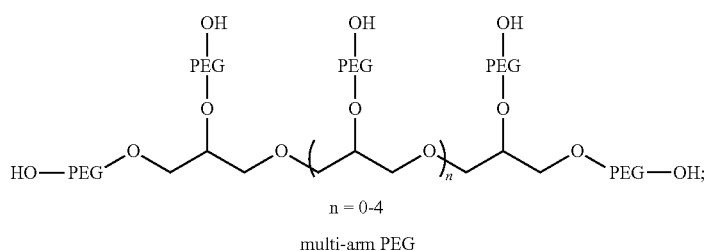
n = 0-4
multi-arm PEG
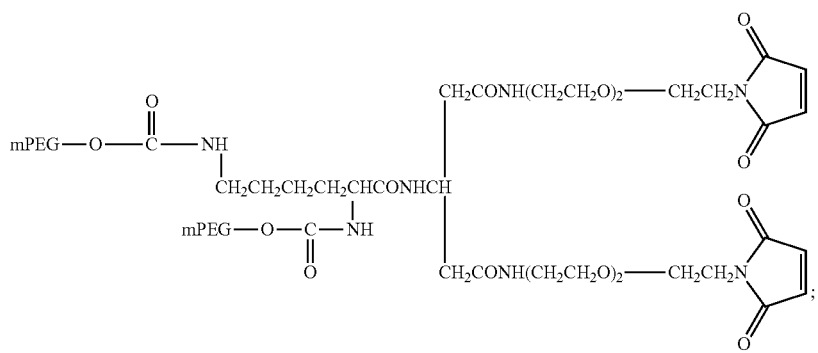
mPEG2-(MAL)²
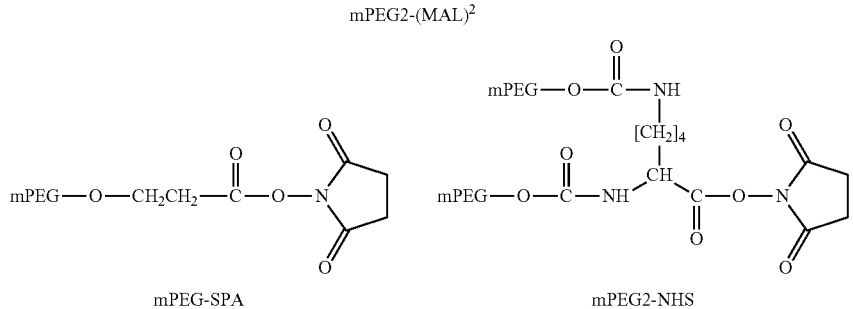
mPEG-SPA; mPEG2-NHS As used herein, a "sulfhydryl-selective reagent" is a reagent which is useful for the attachment of a PEG polymer to a thiol-containing amino acid. Thiol groups on the amino acid residue cysteine are particularly useful for interaction with a sulfhydryl-selective reagent. Sulfhydryl-selective reagents which are useful for such attachment include, but are not limited to maleimide, vinyl sulfone, and thiol. The use of sulfhydryl-selective reagents for coupling to cysteine residues is known in the art and may be adapted as needed (see, e.g., Zalipsky (1995) *Bioconjug. Chem.* 6: 150; Greenwald et al. (2000) *Crit. Rev. Ther. Drug Carrier Syst.* 17: 101; Herman et al. (1994) *Macromol. Chem. Phys.* 195: 203).

The attachment of PEG or another agent, e.g., HSA, to a domain antibody as described herein in an exemplary embodiment, will not impair the ability of the polypeptide to specifically bind CD28. That is, the PEG-linked domain antibody will retain its binding activity relative to a non-PEG-linked counterpart. As used herein, "retains activity" refers to a level of activity of a PEG-linked domain antibody which is at least 10% of the level of activity of a non-PEG-linked domain antibody, including at least about 20%, 30%, 40%, 50%, 60%, 70%, 80%, and up to 90%, including up to about 95%, 98%, and up to 100% of the activity of a non-PEG-linked domain antibody comprising the same antigen-binding domain or domains. More specifically, the activity of a PEG-linked domain antibody compared to a non-PEG linked domain antibody should be determined on an antibody polypeptide molar basis; that is equivalent numbers of moles of each of the PEG-linked and non-PEG-linked domain antibody should be used in each trial. In determining whether a particular PEG-linked domain antibody "retains activity", the activity of a PEG-linked domain antibody may be compared with the activity of the same domain antibody in the absence of PEG.

As used herein, the term "in vivo half-life" refers to the time taken for the serum concentration of a ligand (e.g., a domain antibody) to reduce by about 50%, in vivo, for example due to degradation of the ligand and/or clearance or sequestration of the ligand by natural mechanisms. The domain antibodies described herein can be stabilized in vivo and their half-life increased by binding to molecules, such as PEG, which resist degradation and/or clearance or sequestration. The half-life of a domain antibody is increased if its functional activity persists, in vivo, for a longer period than a similar antibody polypeptide which is not linked to a PEG polymer. Typically, the half-life of a PEGylated domain antibody is increased by at least about 10%, 20%, 30%, 40%, 50%, or more relative to a non-PEGylated domain antibody. Increases in the range of 2×, 3×, 4×, 5×, 10×, 20×, 30×, 40×, 50×, or more of the half-life are possible. Alternatively, or in addition, increases in the range of up to 30×, 40×, 50×, 60×, 70×, 80×, 90×, 100×, or 150× of the half-life are possible. As set forth herein, a PEG-linked domain antibody has a half-life of between 0.25 and 170 hours, including between 1 and 100 hours, further including between 30 and 100 hours, and still further including between 50 and 100 hours, and up to 170, 180, 190, and 200 hours or more.

As used herein, "resistant to degradation" or "resists degradation" with respect to a PEG or other polymer-linked domain antibody monomer or multimer means that the PEG- or other polymer-linked domain antibody monomer or multimer is degraded by no more than about 10% when exposed to pepsin at pH 2.0 for 30 minutes and in an aspect, not degraded at all.

As used herein, "hydrodynamic size" refers to the apparent size of a molecule (e.g., a protein molecule) based on the diffusion of the molecule through an aqueous solution. The diffusion, or motion, of a protein through solution can be processed to derive an apparent size of the protein, where the size is given by the "Stokes radius" or "hydrodynamic radius" of the protein particle. The "hydrodynamic size" of a protein depends on both mass and shape (conformation), such that two proteins having the same molecular mass may have differing hydrodynamic sizes based on the overall conformation of the protein. Hydrodynamic size is measured, for example, by size exclusion chromatography. The hydrodynamic size of a PEG-linked antibody polypeptide, e.g., a domain antibody, can be in the range of about 24 kD to 500 kD; 30 to 500 kD; 40 to 500 kD; 50 to 500 kD; 100 to 500 kD; 150 to 500 kD; 200 to 500 kD; 250 to 500 kD; 300 to 500 kD; 350 to 500 kD; 400 to 500 kD, and 450 to 500 kD. In an aspect, the hydrodynamic size of a PEGylated domain antibody is about 30 to 40 kD; 70 to 80 kD, or 200 to 300 kD. Where a domain antibody is desired for use in imaging applications, the domain antibody should have a hydrodynamic size of between about 50 and 100 kD. Alternatively, where a domain antibody is desired for therapeutic applications, the domain antibody preparation should have a hydrodynamic size of greater than about 200 kD.

As used herein, the term "$IC_{50}$" refers to the concentration of an inhibitor necessary to inhibit a given activity by about 50%. $IC_{50}$ is determined by assaying a given activity, e.g., binding of CD28 to CD80 or CD86, in the presence of varying amounts of the inhibitor (e.g., domain antibody), and plotting the inhibitor concentration versus the activity being targeted. Binding of CD28 to CD80 or CD86 is measured herein by the method described the working examples. Alternatively, surface plasmon resonance (SPR) can be used.

As used herein, the term "$EC_{50}$" refers to the concentration of compound or domain antibody that provokes a response in a subject, wherein the response is halfway between the baseline and the maximum response. The baseline and maximum responses of a subject, with respect to a compound or domain antibody, can be determined by any technique known in the art.

As used herein, the term "fused to a domain antibody" generally means that a polypeptide is fused to a given antibody through use of recombinant DNA techniques, though fusion may occur chemically at the protein level. Thus, an antibody "fused to" another polypeptide, e.g., to another antibody of different binding specificity, does not exist in nature and is generated through recombinant means. The term "fused to a domain antibody" also encompasses the linkage of a polypeptide to a given domain antibody through, for example, disulfide or other chemical linkages, where the fused polypeptide is not naturally found fused to the domain antibody. Recombinant and chemical methods of fusing a polypeptide to another polypeptide, e.g., to an antibody, are well known in the art.

As used herein, the term "Fc domain" refers to the constant region antibody sequences comprising $CH_2$ and $CH_3$ constant domains as delimited according to Kabat et al., supra. The Fc portion of the heavy chain polypeptide has the ability to self-associate, a function which facilitates the formation of divalent antibodies. The term "lacks an Fc domain" means that a given domain antibody lacks at least the portion of an immunoglobulin Fc domain (as such domains are defined according to Kabat et al., 1991, *Sequences of Immunological Interest*, 5$^{th}$ ed. U.S. Dept. Health & Human Services, Washington, D.C.) sufficient to mediate the dimerization of Fc-containing domain antibodies. Dimerization of Fc-containing domain antibodies is measured, for example, by chromatographic methods or by surface plasmon resonance. A domain antibody lacking an Fc domain avoids Fc-platelet interactions and therefore avoids induction of platelet aggregation.

As used herein "treat", "reduce", "prevent", or "alleviate" as it relates to a symptom of disease refer to a decrease of a symptom by at least 10% based on a clinically measurable parameter, or by at least one point on a clinically-accepted scale of disease or symptom severity. As used herein, the term "symptom(s) of systemic lupus erythematosus" refers to any of the clinically relevant symptoms of SLE known to those of skill in the art. Non-limiting examples include the accumulation of IgG autoantibodies (e.g., against nuclear antigens such as chromatin, snRNPs (especially U1, Sm, Ro/SSA and La/SSB), phospholipids and cell surface molecules), hemolytic anemia, thrombocytopenia, leukopenia, glomerulonephritis, vasculitis, arthritis, and serositis). A reduction in such a symptom is a reduction by at least 10% in a clinically measurable parameter, or by at least one point on a clinically-accepted scale of disease severity.

As used herein, the phrase "specifically binds" refers to the binding of an antigen by a domain antibody with a dissociation constant ($K_d$) of 1 µM or lower as measured by surface plasmon resonance analysis using, for example, a BIAcore surface plasmon resonance system and BIAcore™ kinetic evaluation software (e.g., version 2.1). The affinity or $K_d$ for a specific binding interaction, in an aspect, is about 500 nM or lower, and in another aspect, about 300 nM or lower.

As used herein, a "generic ligand" is a ligand that binds a substantial proportion of functional members in a given repertoire, e.g., in a phage display library. Thus, the same generic ligand can bind many members of the repertoire regardless of their target ligand specificities. In general, the presence of a functional generic ligand binding site indicates that the repertoire member is expressed and folded correctly. Thus, binding of the generic ligand to its binding site provides a method for preselecting functional polypeptides from a repertoire of polypeptides. Generic ligands include, for example, Protein A, Protein G and Protein L.

As used herein, the term "universal framework" refers to a single antibody framework sequence corresponding to the regions of an antibody conserved in sequence as defined by Kabat (Kabat et al. (1991) *Sequences of Immunological Interest,* 5$^{th}$ ed. U.S. Dept. Health & Human Services, Washington, D.C.) or corresponding to the human germline immunoglobulin repertoire or structure as defined by Chothia and Lesk, (1987) J. Mol. Biol. 196: 910-917. The use of a single framework, or a set of such frameworks, which has been found to permit the derivation of virtually any binding specificity though variation in the hypervariable regions alone, is included herein.

The term "about" will be understood by persons of ordinary skill in the art and will vary to some extent on the context in which it is used. Generally, about encompasses a range of values that are plus/minus 10% of a referenced value.

The term "corresponds to" as used herein with respect to protein or nucleic acid sequences and/or domains refer to an analogous sequence or structure on a separate protein. For example, a calcium-biding domain of mouse myosin "corresponds to" the calcium-binding domain of a human myosin.

1.2. Acronyms

The following is a list of terms and associated acronyms used herein and apply to the referenced terms, unless otherwise indicated with specific terms and acronyms.

Ab antibody
AIDS acquired immune deficiency syndrome
APC antigen presenting cell
AUC area under the curve
BSA bovine serum albumin
cDNA complementary DNA
CD80 B7-1 co-stimulatory molecule on APCs
CD86 B7-2 co-stimulatory molecule on APCs
CDR complementarity determining region
CTLA-4 a/k/a/ CD152; a high affinity CD80/CD86 receptor on T cells
CRS cytokine release syndrome
dAb domain antibody
DC dendritic cell
DNA deoxyribonucleic acid
EDTA ethylenediaminetetraacetic acid
ELISA enzyme-linked immunosorbent assay
Fab antigen binding region
Fc antibody tail region
FCS fetal calf serum
FW framework
HPLC high performance liquid chromatography
HSA human serum albumin
IFN interferon
IL interleukin
kD kiloDalton
$K_d$ dissociation constant
mAb monoclonal antibody
MAL maleimide
mg milligram
ml milliliter
MLR mixed lymphocyte reaction
mM millimolar
MoDC monocyte-derived dendritic cells
MSA mouse serum albumin
NHS N-hydroxylsuccinimide
ng nanogram
nM nanomolar
pg picogram
pM picomolar
mRNA messenger ribonucleic acid
PBMC peripheral blood mononuclear cells
PCR polymerase chain reaction
PDB Protein Database Base
PEG polyethyleneglycol
PK pharmacokinetics
ppm parts per million
RO receptor occupancy
RT-PCR reverse transcriptase polymerase chain reaction
SA serum albumin
scFV single chain variable fragment
SDS-PAGE sodium dodecyl sulfate-polyacrylamide gel electrophoresis
SEC-MALLS size-exclusion chromatography multi-angle laser light scattering
SPA succinimidyl propionate
SPR surface plasmon resonance
SRBC sheep red blood cells
$t_{1/2}$ half life
TNF tumor necrosis factor
t.u. titer units
µg microgram
µl microliter
µM micromolar
$V_H$ variable heavy-chain domain
$V_L$ variable light-chain domain
VS vinyl sulfate
1×SSC 0.15 M NaCl, 0.015 M sodium citrate, pH 7.0

Domain antibodies are provided that are monovalent for binding to CD28. While not wishing to be bound by any particular theory, it is believed that monovalency for CD28 binding removes the possibility for cross-linking cell surface receptors that occurs with prior art antibodies. Thus, in one aspect, the domain antibodies disclosed herein not only inhibit or antagonize the binding of CD80 or CD86 to CD28, they do not substantially agonize CD28 activity.

In one aspect, the antibodies monovalent for CD28 binding are human domain antibodies. Human domain antibodies can be administered to human patients while largely avoiding the anti-antibody immune response often provoked by the administration of antibodies from other species, e.g., mouse. While murine antibodies can be "humanized" by grafting human constant domains onto the murine antigen-binding domains, human antibodies as disclosed herein are produced without the need for laborious and time-consuming genetic manipulation of a murine antibody sequence.

2. Monovalent Domain Antibodies

The heavy and light polypeptide chains of antibodies comprise variable (V) regions that directly participate in antigen interactions, and constant (C) regions that provide structural support and function in non-antigen-specific interactions with immune effectors. The antigen binding domain of a conventional antibody is comprised of two separate domains: a heavy chain variable domain ($V_H$) and a light chain variable domain ($V_L$, which can be either $V_\kappa$ or $V_\lambda$). The antigen binding site itself is formed by six polypeptide loops: three from the $V_H$ domain (H1, H2 and H3) and three from the $V_L$ domain (L1, L2 and L3). In vivo, a diverse primary repertoire of V genes that encode the $V_H$ and $V_L$ domains is produced by the combinatorial rearrangement of gene segments. C regions include the light chain C regions (referred to as $C_L$ regions) and the heavy chain C regions (referred to as $C_H1$, $C_H2$ and $C_H3$ regions). A naturally-occurring antibody generally comprises two antigen binding domains and is therefore divalent.

A number of smaller antigen binding fragments of naturally occurring antibodies have been identified following protease digestion. These include, for example, the "Fab fragment" ($V_L$-$C_L$/$C_H1$-$V_H$), "Fab' fragment" (a Fab with the heavy chain hinge region), and "F(ab')$_2$ fragment" (a dimer of Fab' fragments joined by the heavy chain hinge region). Recombinant methods have been used to generate such fragments and to generate even smaller antigen-binding fragments, e.g., those referred to as "single chain Fv" (variable fragment) or "scFv," consisting of $V_L$ and $V_H$ joined by a peptide linker ($V_L$-linker-$V_H$) Fab fragments, Fab' fragments and scFv fragments are monovalent for antigen binding, as they each comprise only one antigen binding domain comprising one $V_H$/$V_L$ dimer.

A domain antibody, or "dAb", binds antigen independently of other V domains; however, a domain antibody can be present in a homo- or heteromultimer with other $V_H$ or $V_L$ domains where the other domains are not required for antigen binding by the dAb, i.e., where the dAb binds antigen independently of the additional $V_H$ or $V_L$ domains. The preparation of domain antibodies is described and exemplified herein below.

Antibody single variable domains, for example, $V_{HH}$, are the smallest antigen-binding antibody unit known. For use in therapy, human antibodies are especially advantageous, primarily because they are not as likely to provoke an immune response when administered to a patient. Comparisons of camelid $V_{HH}$ with the $V_H$ domains of human antibodies reveals several key differences in the framework regions of the camelid $V_{HH}$ domain corresponding to the $V_H$/$V_L$ interface of the human $V_H$ domains. Mutation of these residues of human $V_H3$ to more closely resemble the $V_{HH}$ sequence (specifically Gly 44→Glu, Leu 45→Arg and Trp 47→Gly) has been performed to produce "camelized" human $V_H$ domains that retain antigen binding activity (Davies & Riechmann (1994) *FEBS Lett.* 339: 285-290) yet have improved expression and solubility. (Variable domain amino acid numbering used herein is consistent with the Kabat numbering convention (Kabat et al. (1991) *Sequences of Immunological Interest*, 5$^{th}$ ed. U.S. Dept. Health & Human Services, Washington, D.C.)) WO 03/035694 (Muyldermans) reports that the Trp 103→Arg mutation improves the solubility of non-camelid $V_H$ domains. Davies & Riechmann (1995) *Biotechnology* N.Y. 13: 475-479 also report production of a phage-displayed repertoire of camelized human $V_H$ domains and selection of clones that bind hapten with affinities in the range of 100-400 nM, but clones selected for binding to protein antigen had weaker affinities.

Domain antibodies can be generated in several different ways. For example, the nucleic acid sequence encoding heavy and light chains of an antibody known to bind CD28 can be manipulated to generate a number of different domain antibodies that are monovalent for CD28 binding. Thus, given the sequences encoding the heavy and light chain polypeptides that constitute an antibody and standard molecular cloning methodologies, one can generate monovalent antigen-binding polypeptide constructs such as Fab fragments, scFv, dAbs, or even bispecific antibodies (i.e., antibodies that comprise two different antigen-binding moieties and can therefore bind two separate antigens, and in an aspect, simultaneously) that are monovalent for CD28.

2.1. General Strategy and Methods for Design of Domain Antibodies

One means of generating domain antibodies specific for CD28 is to amplify and express the $V_H$ and $V_L$ regions of the heavy chain and light chain gene sequences isolated, for example, from a hybridoma (e.g., a mouse hybridoma) that expresses domain antibody. The boundaries of $V_H$ and $V_L$ domains are set out by Kabat et al. (Kabat et al. (1991) *Sequences of Immunological Interest*, 5$^{th}$ ed. U.S. Dept. Health & Human Services, Washington, D.C.). The information regarding the boundaries of the $V_H$ and $V_L$ domains of heavy and light chain genes is used to design PCR primers that amplify the V domain from a heavy or light chain coding sequence encoding an antibody known to bind CD28. The amplified V domains are inserted into a suitable expression vector, e.g., pHEN-1 (Hoogenboom et al. (1991) *Nucleic Acids Res.* 19: 4133-4137) and expressed, e.g., as a fusion of the $V_H$ and $V_L$ in a scFv or other suitable monovalent format. The resulting polypeptide is then screened for high affinity monovalent binding to CD28. In conjunction with the methods set forth herein, screening for binding is performed as known in the art or as described herein below.

Alternatively, library screening methods can be used to identify monovalent CD28-specific binding proteins. Phage display technology (see, e.g., Smith (1985) *Science* 228: 1315; Scott & Smith (1990) *Science* 249: 386; McCafferty et al. (1990) *Nature* 348: 552) provides an approach for the selection of domain antibodies which bind a desired target from among large, diverse repertoires of domain antibodies. These phage-antibody libraries can be grouped into two categories: natural libraries which use rearranged V genes harvested from human B cells (Marks et al. (1991) *J. Mol. Biol.*, 222: 581; Vaughan et al. (1996) *Nature Biotech.*, 14: 309) or synthetic libraries whereby germline V gene segments or other domain antibody coding sequences are "rearranged" in vitro (Hoogenboom & Winter (1992) *J. Mol. Biol.*, 227: 381; Nissim et al. (1994) *EMBO J.*, 13: 692; Griffiths et al. (1994) *EMBO J.*, 13: 3245; De Kruif et al. (1995) *J. Mol. Biol.*, 248: 97) or where synthetic CDRs are incorporated into a single rearranged V gene (Barbas et al. (1992) *Proc. Natl. Acad. Sci. USA*, 89: 4457). Methods involving genetic display packages (e.g., phage display, polysome display) are well-suited for the selection of monovalent CD28-specific antibody constructs because they generally express only monovalent fragments, rather than whole, divalent antibodies, on the display packages. Methods for the preparation of phage display libraries displaying various antibody fragments are described in the preceding references. Such methods are also described, for example, in U.S. Pat. No. 6,696,245, which is incorporated herein by reference. The methods described in the '245 patent generally involve the randomization of selected regions of immunoglobulin gene coding regions, in particular $V_H$ and $V_L$ coding regions, while leaving other regions non-randomized (see below). The '245 patent also describes the generation of scFv constructs comprising individually randomized $V_H$ and $V_L$ domains.

Analysis of the structures and sequences of antibodies has shown that five of the six antigen binding loops (H1, H2, L1, L2, L3) possess a limited number of main-chain conformations or canonical structures (Chothia and Lesk (1987) *J. Mol. Biol.* 196: 901; Chothia et al. (1989) *Nature* 342: 877). The main-chain conformations are determined by (i) the length of the antigen binding loop, and (ii) particular residues, or types of residue, at certain key positions in the antigen binding loop and the antibody framework. For example, analysis of the loop lengths and key residues has enabled the prediction of the main-chain conformations of H1, H2, L1, L2 and L3 encoded by the majority of human antibody sequences (Chothia et al. (1992) *J. Mol. Biol.* 227: 799; Tomlinson et al. (1995) *EMBO J.* 14: 4628; Williams et al. (1996) *J. Mol. Biol.* 264: 220). Although the H3 region is much more diverse in terms of sequence, length and structure (due to the use of D segments), it also forms a limited number of main-chain conformations for short loop lengths which depend on the length and the presence of particular residues, or types of residue, at key positions in the loop and the antibody framework (Martin et al. (1996) *J. Mol. Biol.* 263: 800; Shirai et al. (1996) *FEBS Letters* 399: 1.

While, in one approach, diversity can be added to synthetic repertoires at any site in the CDRs of the various antigen-binding loops, this approach results in a greater proportion of V domains that do not properly fold and therefore contribute to a lower proportion of molecules with the potential to bind antigen. An understanding of the residues contributing to the main chain conformation of the antigen-binding loops permits the identification of specific residues to diversify in a synthetic repertoire of $V_H$ or $V_L$ domains. That is, diversity is best introduced in residues that are not essential to maintaining the main chain conformation. As an example, for the diversification of loop L2, the conventional approach would be to diversify all the residues in the corresponding CDR (CDR2) as defined by Kabat et al. (Kabat et al. (1991) *Sequences of Immunological Interest*, 5$^{th}$ ed. U.S. Dept. Health & Human Services, Washington, D.C.), some seven residues. However, for L2, it is known that positions 50 and 53 are diverse in naturally occurring antibodies and are observed to make contact with the antigen. One approach would be to diversify only those two residues in this loop. This represents a significant improvement in terms of the functional diversity required to create a range of antigen binding specificities.

Immunoglobulin polypeptide libraries can advantageously be designed to be based on predetermined variable domain main chain conformation. Such libraries may be constructed as described in International Patent Application WO 99/20749, the contents of which are incorporated herein by reference. Thus, in one aspect, a domain antibody comprises the amino acid sequence of a given human germline V region gene segment, e.g., $V_H$ germline gene segment DP-47, or $V_\kappa$ germline gene segment DPK9. Such variable region polypeptides can be used for the production of scFvs or Fabs, e.g., a scFv or Fab comprising (i) an antibody heavy chain variable domain ($V_H$), or antigen binding fragment thereof, which comprises the amino acid sequence of germline $V_H$ segment DP-47 and (ii) an antibody light chain variable domain ($V_L$), or antigen binding fragment thereof, which comprises the amino acid sequence of germline $V_\kappa$ segment DPK9. Diversification of sequences within the context of the selected heavy and light chain germline gene segments, e.g., DP-47, DPK 9, DP45, DP38, etc. can generate a repertoire of diverse immunoglobulin coding sequences. One approach to diversification is described below in the context of generating a library of diversified domain antibody or scFv sequences. These variable region polypeptides can also be expressed as domain antibodies and screened for high affinity binding to CD28. The repertoire can be cloned into or generated in a vector suitable for phage display, e.g., a lambda or filamentous bacteriophage display vector and is then screened for binding to a given target antigen, e.g., CD28.

3. Preparation of Domain Antibodies

A domain antibody is a folded polypeptide domain which comprises sequences characteristic of immunoglobulin variable domains and which specifically binds an antigen (e.g., dissociation constant of 500 nM or less), and which binds antigen as a single variable domain; that is, there is one binding site provided by a domain antibody without any complementary variable domain. A domain antibody therefore includes complete antibody variable domains as well as modified variable domains, for example in which one or more loops have been replaced by sequences which are not characteristic of antibody variable domains or antibody variable domains which have been truncated or comprise N- or C-terminal extensions, as well as folded fragments of variable domains which retain a dissociation constant of about 500 nM less (e.g., about 450 nM or less, about 400 nM or less, about 350 nM or less, about 300 nM or less, about 250 nM or less, about 200 nM or less, about 150 nM or less, about 100 nM or less) and the target antigen specificity of the full-length domain. In an exemplary embodiment, an antibody single variable domain useful in the compositions and methods set forth herein is selected from the group of $V_H$ and $V_L$, including $V_{kappa}$ and $V_{lambda}$. In an exemplary embodiment, the domain antibodies of use herein are "human" as that term is defined herein.

3.1.1. Structure of Ligands

According to one aspect disclosed herein, two or more non-complementary epitope binding domains are linked so that they are in a closed conformation as herein defined. Advantageously, they may be further attached to a skeleton which may, as an alternative, or on addition to a linker described herein, facilitate the formation and/or maintenance of the closed conformation of the epitope binding sites with respect to one another. Alternatively, the domain antibodies disclosed herein may be constructed using scaffold or skeleton frameworks as discussed herein.

Ligand skeletons may be based on immunoglobulin molecules or may be non-immunoglobulin in origin as set forth elsewhere herein. Immunoglobulin skeletons as herein defined may include any one or more of those selected from the following: an immunoglobulin molecule comprising at least (i) the CL (kappa or lambda subclass) domain of an antibody; or (ii) the CH1 domain of an antibody heavy chain; an immunoglobulin molecule comprising the CH1 and CH2 domains of an antibody heavy chain; an immunoglobulin molecule comprising the CH1, CH2 and CH3 domains of an antibody heavy chain; or any of the subset (ii) in conjunction with the CL (kappa or lambda subclass) domain of an antibody. A hinge region domain may also be included. Such combinations of domains may, for example, mimic natural antibodies, such as IgG or IgM, or fragments thereof, such as Fv, scFv, Fab, or F(ab')$_2$ molecules. Those skilled in the art will be aware that this list is not intended to be exhaustive.

Each epitope binding domain comprises a protein scaffold and one or more CDRs which are involved in the specific interaction of the domain with one or more epitopes. Advantageously, an epitope binding domain disclosed herein comprises three CDRs. Suitable protein scaffolds, in addition to those based on immunoglobulin domains, may also be based on protein scaffolds or skeletons other than immunoglobulin domains. For example natural bacterial receptors such as SpA have been used as scaffolds for the grafting of CDRs to generate ligands which bind specifically to one or more epitopes. Details of this procedure are described in U.S. Pat. No. 5,831,012. Other suitable scaffolds include those based on fibronectin and affibodies (Affibody, Bromma, Sweden). Details of suitable procedures are described in WO 98/58965. Other suitable scaffolds include lipocallin and CTLA4, as described in van den Beuken et al., (2001) *J. Mol. Biol.* 310: 591-601, and scaffolds such as those described in WO 00/69907 (Medical Research Council), which are based for example on the ring structure of bacterial GroEL or other chaperone polypeptides. Other non-immunoglobulin based scaffolds which may be used include those based on the LDL receptor class A, EGF domain monomers and multimers, and scaffolds available from Biorexis (King of Prussia, Pa.) or Avidia (Mountain View, Calif.). Other non-immunoglobulin scaffolds which may be used are described, for example, in WO 05/040229, WO 04/044011, and US 2005/0089932.

3.1.2. Selection of the Main-Chain Conformation

The members of the immunoglobulin superfamily all share a similar fold for their polypeptide chain. For example, although antibodies are highly diverse in terms of their primary sequence, comparison of sequences and crystallographic structures has revealed that, contrary to expectation, five of the six antigen binding loops of antibodies (H1, H2, L1, L2, L3) adopt a limited number of main-chain conformations, or canonical structures (Chothia and Lesk (1987) *J. Mol. Biol.*, 196: 901; Chothia et al. (1989) *Nature*, 342: 877). Analysis of loop lengths and key residues has therefore enabled prediction of the main-chain conformations of H1, H2, L1, L2, and L3 found in the majority of human antibodies (Chothia et al. (1992) *J. Mol. Biol.*, 227: 799; Tomlinson et al. (1995) *EMBO J.*, 14: 4628; Williams et al. (1996) *J. Mol. Biol.*, 264: 220). Although the H3 region is much more diverse in terms of sequence, length, and structure (due to the use of D segments), it also forms a limited number of main-chain conformations for short loop lengths which depend on the length and the presence of particular residues, or types of residues, at key positions in the loop and the antibody framework (Martin et al. (1996) *J. Mol. Biol.*, 263: 800; Shirai et al. (1996) *FEBS Letters*, 399: 1).

The ligands disclosed herein can be selected and/or assembled from libraries of domains, such as libraries Of $V_H$ domains and/or libraries of $V_L$ domains. Moreover, the ligands disclosed herein may themselves be provided in the form of libraries. In one aspect disclosed herein, libraries of ligands and/or domains are designed in which certain loop lengths and key residues have been chosen to ensure that the main-chain conformation of the members is known. Advantageously, these are real conformations of immunoglobulin superfamily molecules found in nature, to minimize the chances that they are non-functional, as discussed above. Germline V gene segments serve as one exemplary basic framework for constructing antibody or T cell receptor libraries; other sequences are also of use. Variations may occur at a low frequency, such that a small number of functional members may possess an altered main-chain conformation, which does not affect its function.

Canonical structure theory is also of use to assess the number of different main-chain conformations encoded by ligands, to predict the main-chain conformation based on ligand sequences and to choose residues for diversification which do not affect the canonical structure. It is known that, in the human $V_\kappa$ domain, the L1 loop can adopt one of four canonical structures, the L2 loop has a single canonical structure and that 90% of human $V_\kappa$ domains adopt one of four or five canonical structures for the L3 loop (Tomlinson et al. (1995) supra); thus, in the $V_\kappa$ domain alone, different canonical structures can combine to create a range of different main-chain conformations. Given that the $V_\lambda$ domain encodes a different range of canonical structures for the L1, L2, and L3 loops, and that $V_\kappa$ and $V_\lambda$ domains can pair with any $V_H$ domain which can encode several canonical structures for the H1 and H2 loops, the number of canonical structure combinations observed for these five loops is very large. This implies that the generation of diversity in the main-chain conformation may be essential for the production of a wide range of binding specificities. However, by constructing an antibody library based on a single known main-chain conformation it has been found, contrary to expectation, that diversity in the main-chain conformation is not required to generate sufficient diversity to target substantially all antigens. Even more surprisingly, the single main-chain conformation need not be a consensus structure. A single naturally occurring conformation can be used as the basis for an entire library. Thus, in one aspect, the ligands disclosed herein possess a single known main-chain conformation.

The single main-chain conformation that is chosen is in an aspect, commonplace among molecules of the immunoglobulin superfamily type in question. A conformation is commonplace when a significant number of naturally occurring molecules are observed to adopt it. Accordingly, in one aspect disclosed herein, the natural occurrence of the different main-chain conformations for each binding loop of an immunoglobulin domain are considered separately and then a naturally occurring variable domain is chosen which possesses the desired combination of main-chain conformations for the different loops. If none is available, the nearest equivalent may be chosen. It is preferable that the desired combination of main-chain conformations for the different loops is created by selecting germline gene segments which encode the desired main-chain conformations. It is more preferable, that the selected germline gene segments are frequently expressed in nature, and most preferable that they are the most frequently expressed of all natural germline gene segments.

In designing ligands or libraries thereof the incidence of the different main-chain conformations for each of the antigen binding loops may be considered separately. For H1, H2, L1, L2, and L3, a given conformation that is adopted by between 20% and 100% of the antigen binding loops of naturally occurring molecules is chosen. Typically, its observed incidence is above 35% (i.e. between 35% and 100%) and, ideally, above 50% or even above 65%. Since the vast majority of H3 loops do not have canonical structures, it is preferable to select a main-chain conformation which is commonplace among those loops which do display canonical structures. For each of the loops, the conformation which is observed most often in the natural repertoire is therefore selected. In human antibodies, the most popular canonical structures (CS) for each loop are as follows: H1-CS 1 (79% of the expressed repertoire), H2-CS 3 (46%), L1-CS 2 of V, (39%), L2-CS1 (100%), L3-CS1 of $V_\kappa$ (36%) (calculation assumes a κ:λ ratio of 70:30, Hood et al. (1967) *Cold Spring Harbor Symp. Quant. Biol.*, 48: 133). For H3 loops that have canonical structures, a CDR3 length (Kabat et al. (1991) *Sequences of proteins of immunological interest*, U.S. Department of Health and Human Services) of seven residues with a salt-bridge from residue 94 to residue 101 appears to be the most common. There are at least 16 human antibody sequences in the EMBL data library with the required H3 length and key residues to form this conformation and at least two crystallographic structures in the protein data bank which can be used as a basis for antibody modeling (2cgr and 1tet). The most frequently expressed germline gene segments that this combination of canonical structures are the $V_H$ segment 3-23 (DP-47), the $J_H$ segment JH4b, the $V_\kappa$ segment O2/O12 (DPK9) and the $J_\kappa$ segment $J_\kappa 1$. $V_H$ segments DP45 and DP38 are also suitable. These segments can therefore be used in combination as a basis to construct a library with the desired single main-chain conformation.

Alternatively, instead of choosing the single main-chain conformation based on the natural occurrence of the different main-chain conformations for each of the binding loops in isolation, the natural occurrence of combinations of main-chain conformations is used as the basis for choosing the single main-chain conformation. In the case of antibodies, for example, the natural occurrence of canonical structure combinations for any two, three, four, five, or for all six of the antigen binding loops can be determined. Here, it is preferable that the chosen conformation is commonplace in naturally occurring antibodies and most preferable that it observed most frequently in the natural repertoire. Thus, in human antibodies, for example, when natural combinations of the five antigen binding loops, H1, H2, L1, L2, and L3, are considered, the most frequent combination of canonical structures is determined and then combined with the most popular conformation for the H3 loop, as a basis for choosing the single main-chain conformation.

3.2. Preparation of Domain Antibodies

Domain antibodies are prepared in a number of ways. For each of these approaches, well-known methods of preparing (e.g., amplifying, mutating, etc.) and manipulating nucleic acid sequences are applicable.

One means of preparing a domain antibody is to amplify and express the $V_H$ or $V_L$ region of a heavy chain or light chain gene for a cloned antibody known to bind the desired antigen. That is, the $V_H$ or $V_L$ domain of a known domain antibody coding region can be amplified and expressed as a single domain (or as a fusion of a single domain) and evaluated for binding to CD28. The boundaries of $V_H$ and $V_L$ domains are set out by Kabat et al. (Kabat et al. (1991) *Sequences of Immunological Interest*, 5th ed. U.S. Dept. Health & Human Services, Washington, D.C.). The information regarding the boundaries of the $V_H$ and $V_L$ domains of heavy and light chain genes is used to design PCR primers that amplify the V domain from a cloned heavy or light chain coding sequence encoding an antibody known to bind CD28. The amplified V domain is inserted into a suitable expression vector, e.g., pHEN-1 (Hoogenboom et al. (1991) *Nucleic Acids Res.* 19: 4133-4137) and expressed, either alone or as a fusion with another polypeptide sequence.

The $V_H$ gene is produced by the recombination of three gene segments, $V_H$, D and $J_H$. In humans, there are approximately 51 functional $V_H$ segments (Cook and Tomlinson (1995) *Immunol Today* 16: 237), 25 functional D segments (Corbett et al. (1997) *J. Mol. Biol.* 268: 69) and 6 functional $J_H$ segments (Ravetch et al. (1981) *Cell* 27: 583), depending on the haplotype. The $V_H$ segment encodes the region of the polypeptide chain which forms the first and second antigen binding loops of the $V_H$ domain (H1 and H2), while the $V_H$, D and $J_H$ segments combine to form the third antigen binding loop of the $V_H$ domain (H3).

The $V_L$ gene is produced by the recombination of only two gene segments, $V_L$ and $J_L$. In humans, there are approximately 40 functional $V_\kappa$ segments (Schäble and Zachau (1993) *Biol. Chem. Hoppe-Seyler* 374: 1001), 31 functional $V_\lambda$ segments (Williams et al. (1996) *J. Mol. Biol.* 264: 220; Kawasaki et al. (1997) *Genome Res.* 7: 250), 5 functional $J_\kappa$ segments (Hieter et al. (1982) *J. Biol. Chem.* 257: 1516) and 4 functional $J_\lambda$ segments (Vasicek and Leder (1990) *J. Exp. Med.* 172: 609), depending on the haplotype. The $V_L$ segment encodes the region of the polypeptide chain which forms the first and second antigen binding loops of the $V_L$ domain (L1 and L2), while the $V_L$ and $J_L$ segments combine to form the third antigen binding loop of the $V_L$ domain (L3). Antibodies selected from this primary repertoire are believed to be sufficiently diverse to bind almost all antigens with at least moderate affinity. High affinity antibodies are produced in vivo by "affinity maturation" of the rearranged genes, in which point mutations are generated and selected by the immune system on the basis of improved binding.

In one approach, a repertoire of $V_H$ or $V_L$ domains, in an aspect, human $V_H$ or $V_L$ domains, is screened by, for example, phage display, panning against the desired antigen. Methods for the construction of bacteriophage display libraries and lambda phage expression libraries are well known in the art, and taught, for example, by: McCafferty et al. (1990) *Nature* 348: 552; Kang et al. (1991) *Proc. Natl. Acad. Sci. U.S.A.*, 88: 4363; Clackson et al. (1991) *Nature* 352: 624; Lowman et al. (1991) *Biochemistry* 30: 10832; Burton et al. (1991) *Proc. Natl. Acad. Sci. U.S.A.* 88: 10134; Hoogenboom et al. (1991) *Nucleic Acids Res.* 19: 4133; Chang et al. (1991) *J. Immunol.* 147: 3610; Breitling et al. (1991) *Gene* 104: 147; Marks et al. (1991) *J. Mol. Biol.* 222: 581; Barbas et al. (1992) *Proc. Natl. Acad. Sci. U.S.A.* 89: 4457; Hawkins and Winter (1992) *J. Immunol.*, 22: 867; Marks et al. (1992) *J. Biol. Chem.*, 267: 16007; and Lerner et al. (1992) *Science,* 258: 1313. Fab phage display libraries are taught, for example, by U.S. Pat. No. 5,922,545. scFv phage libraries are taught, for example, by Huston et al. (1988) *Proc. Natl. Acad. Sci. U.S.A.* 85: 5879-5883; Chaudhary et al. (1990) *Proc. Natl. Acad. Sci. U.S.A.* 87: 1066-1070; McCafferty et al. (1990) supra; Clackson et al. (1991) supra; Marks et al. (1991) supra; Chiswell et al. (1992) *Trends Biotech.* 10: 80; and Marks et al. (1992) supra. Various embodiments of scFv libraries displayed on bacteriophage coat proteins have been described. Refinements of phage display approaches are also known, for example as described in WO96/06213 and WO92/01047 (Medical Research Council et al.) and WO97/08320 (Morphosys, supra).

The repertoire of $V_H$ or $V_L$ domains can be a naturally-occurring repertoire of immunoglobulin sequences or a synthetic repertoire. A naturally-occurring repertoire is one prepared, for example, from immunoglobulin-expressing cells harvested from one or more individuals. Such repertoires can be "naïve," i.e., prepared, for example, from human fetal or newborn immunoglobulin-expressing cells, or rearranged, i.e., prepared from, for example, adult human B cells. Natural repertoires are described, for example, by Marks et al. (1991) *J. Mol. Biol.* 222: 581 and Vaughan et al. (1996) *Nature Biotech.* 14: 309. If desired, clones identified from a natural repertoire, or any repertoire, for that matter, that bind the target antigen are then subjected to mutagenesis and further screening in order to produce and select variants with improved binding characteristics.

Synthetic repertoires of domain antibodies are prepared by artificially introducing diversity into a cloned V domain. Synthetic repertoires are described, for example, by Hoogenboom & Winter (1992) *J. Mol. Biol.* 227: 381; Barbas et al. (1992) *Proc. Natl. Acad. Sci. U.S.A.* 89: 4457; Nissim et al. (1994) *EMBO J.* 13: 692; Griffiths et al. (1994) *EMBO J.* 13: 3245; DeKriuf et al. (1995) *J. Mol. Biol.* 248: 97; and WO 99/20749.

In one aspect, synthetic variable domain repertoires are prepared in $V_H$ or $V_\kappa$ backgrounds, based on artificially diversified germline $V_H$ or $V_\kappa$ sequences. For example, the $V_H$ domain repertoire can be based on cloned germline $V_H$ gene segments V3-23/DP47 (Tomlinson et al. (1992) *J. Mol. Biol.* 227: 776) and JH4b. The $V_\kappa$ domain repertoire can be based, for example, on germline $V_\kappa$ gene segments O2/O12/DPK9 (Cox et al. (1994) *Eur. J. Immunol.* 24: 827) and $J_\kappa 1$. Diversity is introduced into these or other gene segments by, for example, PCR mutagenesis. Diversity can be randomly introduced, for example, by error prone PCR (Hawkins, et al. (1992) *J. Mol. Biol.* 226: 889) or chemical mutagenesis. As discussed above, however, in one embodiment the introduction of diversity is targeted to particular residues. In another embodiment the desired residues are targeted by introduction of the codon NNK using mutagenic primers (using the IUPAC nomenclature, where N=G, A, T or C, and K=G or T), which encodes all amino acids and the TAG stop codon. Other codons which achieve similar ends are also of use, including the NNN codon (which leads to the production of the additional stop codons TGA and TAA), DVT codon ((A/G/T)(A/G/C)T), DVC codon ((A/G/T)(A/G/C)C), and DVY codon ((A/G/T)(A/G/C)(C/T). The DVT codon encodes 22% serine and 11% tyrosine, asparagine, glycine, alanine, aspartate, threonine and cysteine, which most closely mimics the distribution of amino acid residues for the antigen binding sites of natural human antibodies. Repertoires are made using PCR primers having the selected degenerate codon or codons at each site to be diversified. PCR mutagenesis is well known in the art.

In one aspect, diversity is introduced into the sequence of human germline $V_H$ gene segments V3-23/DP47 (Tomlinson et al. (1992) *J. Mol. Biol.* 227: 7768) and JH4b using the NNK codon at sites H30, H31, H33, H35, H50, H52, H52a, H53, H55, H56, H58, H95, H97, and H98, corresponding to diversity in CDRs 1, 2 and 3, with the numbering as used in U.S. Pat. No. 6,696,245.

In another aspect, diversity is also introduced into the sequence of human germline $V_H$ gene segments V3-23/DP47 and JH4b, for example, using the NNK codon at sites H30, H31, H33, H35, H50, H52, H52a, H53, H55, H56, H58, H95, H97, H98, H99, H1100, H100a, and H100b, corresponding to diversity in CDRs 1, 2 and 3, with the numbering as used in U.S. Pat. No. 6,696,245.

In another aspect, diversity is introduced into the sequence of human germline $V_\kappa$ gene segments O2/O12/DPK9 and $J_\kappa 1$, for example, using the NNK codon at sites L30, L31, L32, L34, L50, L53, L91, L92, L93, L94, and L96, corresponding to diversity in CDRs 1, 2 and 3, with the numbering as used in U.S. Pat. No. 6,696,245.

Diversified repertoires are cloned into phage display vectors as known in the art and as described, for example, in WO 99/20749. In general, the nucleic acid molecules and vector constructs required for the compositions and methods set forth herein are available in the art and are constructed and manipulated as set forth in standard laboratory manuals, such as Sambrook et al. (1989), Molecular Cloning: A Laboratory Manual, Cold Spring Harbor, USA and subsequent editions.

The manipulation of nucleic acids as set forth herein is typically carried out in recombinant vectors. As used herein, "vector" refers to a discrete element that is used to introduce heterologous DNA into cells for the expression and/or replication thereof. Methods by which to select or construct and, subsequently, use such vectors are well known to one of skill in the art. Numerous vectors are publicly available, including bacterial plasmids, bacteriophage, artificial chromosomes and episomal vectors. Such vectors may be used for simple cloning and mutagenesis; alternatively, as is typical of vectors in which repertoire (or pre-repertoire) members herein are carried, a gene expression vector is employed. A vector of use set forth herein is selected to accommodate a polypeptide coding sequence of a desired size, typically from 0.25 kilobase (kb) to 40 kb in length. A suitable host cell is transformed with the vector after in vitro cloning manipulations. Each vector contains various functional components, which generally include a cloning (or "polylinker") site, an origin of replication and at least one selectable marker gene. If a given vector is an expression vector, it additionally possesses one or more of the following: enhancer element, promoter, transcription termination and signal sequences, each positioned in the vicinity of the cloning site, such that they are operatively linked to the gene encoding a polypeptide repertoire member as set forth herein.

Both cloning and expression vectors generally contain nucleic acid sequences that enable the vector to replicate in one or more selected host cells. Typically in cloning vectors, this sequence is one that enables the vector to replicate independently of the host chromosomal DNA and includes origins of replication or autonomously replicating sequences. Such sequences are well known for a variety of bacteria, yeast and viruses. The origin of replication from the plasmid pBR322 is suitable for most Gram-negative bacteria, the 2 micron plasmid origin is suitable for yeast, and various viral origins (e.g. SV 40, adenovirus) are useful for cloning vectors in mammalian cells. Generally, the origin of replication is not needed for mammalian expression vectors unless these are used in mammalian cells able to replicate high levels of DNA, such as COS cells.

Advantageously, a cloning or expression vector also contains a selection gene also referred to as selectable marker. This gene encodes a protein necessary for the survival or growth of transformed host cells grown in a selective culture medium. Host cells not transformed with the vector containing the selection gene will therefore not survive in the culture medium. Typical selection genes encode proteins that confer resistance to antibiotics and other toxins, e.g. ampicillin, neomycin, methotrexate or tetracycline, complement auxotrophic deficiencies, or supply critical nutrients not available in the growth media.

Because the replication of vectors herein is most conveniently performed in *E. coli*, an *E. coli*-selectable marker, for example, the β-lactamase gene that confers resistance to the antibiotic ampicillin, is of use. These can be obtained from *E. coli* plasmids, such as pBR322 or a pUC plasmid such as pUC18 or pUC19. However, other plasmid microorganism combinations can also be reasonably substituted.

Expression vectors usually contain a promoter that is recognized by the host organism and is operably linked to the coding sequence of interest. Such a promoter may be inducible or constitutive. The term "operably linked" refers to a juxtaposition wherein the components described are in a relationship permitting them to function in their intended manner. A control sequence "operably linked" to a coding sequence is ligated in such a way that expression of the coding sequence is achieved under conditions compatible with the control sequences.

Promoters suitable for use with prokaryotic hosts include, for example, the β-lactamase and lactose promoter systems, alkaline phosphatase, the tryptophan (trp) promoter system and hybrid promoters such as the tac promoter. Promoters for use in bacterial systems will also generally contain a Shine-Dalgarno sequence operably linked to the coding sequence.

In libraries or repertoires as described herein, vectors may be expression vectors that enable the expression of a nucleotide sequence corresponding to a polypeptide library member. Thus, selection is performed by separate propagation and expression of a single clone expressing the polypeptide library member or by use of any selection display system. As described above, one selection display system uses bacteriophage display. Thus, phage or phagemid vectors can be used. Vectors may be phagemid vectors, which have an E. coli origin of replication (for double stranded replication) and also a phage origin of replication (for production of single-stranded DNA). The manipulation and expression of such vectors is well known in the art (Hoogenboom and Winter (1992) supra; Nissim et al. (1994) supra). Briefly, the vector contains a β-lactamase or other selectable marker gene to confer selectivity on the phagemid, and a lac promoter upstream of a expression cassette that consists (N to C terminal) of a pelB leader sequence (which directs the expressed polypeptide to the periplasmic space), a multiple cloning site (for cloning the nucleotide version of the library member), optionally, one or more peptide tags (for detection), optionally, one or more TAG stop codons and the phage protein pIII. In one embodiment, the vector encodes, rather than the pelB leader sequence, a eukaryotic GAS1 leader sequence which serves to direct the secretion of the fusion polypeptide to the periplasmic space in E. coli or to the medium in eukaryotic cell systems. Using various suppressor and non-suppressor strains of E. coli and with the addition of glucose, iso-propyl thio-β-D-galactoside (IPTG) or a helper phage, such as VCS M13, the vector is able to replicate as a plasmid with no expression, produce large quantities of the polypeptide library member only, or produce phage, some of which contain at least one copy of the polypeptide-pIII fusion on their surface.

An example of a vector is the pHEN1 phagemid vector (Hoogenboom et al. (1991) *Nucl. Acids Res.* 19: 4133-4137; sequence is available, e.g., as SEQ ID NO:7 in WO 03/031611), in which the production of pIII fusion protein is under the control of the LacZ promoter, which is inhibited in the presence of glucose and induced with IPTG. When grown in suppressor strains of E. coli, e.g., TG1, the gene III fusion protein is produced and packaged into phage, while growth in non-suppressor strains, e.g., HB2151, permits the secretion of soluble fusion protein into the bacterial periplasm and into the culture medium. Because the expression of gene III prevents later infection with helper phage, the bacteria harboring the phagemid vectors are propagated in the presence of glucose before infection with VCSM13 helper phage for phage rescue.

Construction of vectors as set forth herein employs conventional ligation techniques. Isolated vectors or DNA fragments are cleaved, tailored, and re-ligated in the form desired to generate the required vector. If desired, sequence analysis to confirm that the correct sequences are present in the constructed vector is performed using standard methods. Suitable methods for constructing expression vectors, preparing in vitro transcripts, introducing DNA into host cells, and performing analyses for assessing expression and function are known to those skilled in the art. The presence of a gene sequence in a sample is detected, or its amplification and/or expression quantified by conventional methods, such as Southern or Northern analysis, Western blotting, dot blotting of DNA, RNA or protein, in situ hybridization, immunocytochemistry or sequence analysis of nucleic acid or protein molecules. Those skilled in the art will readily envisage how these methods may be modified, if desired.

3.3. Screening Domain Antibodies for Antigen Binding

Following expression of a repertoire of domain antibodies on the surface of phage, selection is performed by contacting the phage repertoire with immobilized target antigen, washing to remove unbound phage, and propagation of the bound phage, the whole process frequently referred to as "panning". This process is applicable to the screening of domain antibodies as well as other antibody fragments that can be expressed on a display library, e.g., scFv, Fab, etc. Alternatively, phage are pre-selected for the expression of properly folded member variants by panning against an immobilized generic ligand (e.g., protein A or protein L) that is only bound by folded members. This has the advantage of reducing the proportion of non-functional members, thereby increasing the proportion of members likely to bind a target antigen. Pre-selection with generic ligands is taught in WO 99/20749, for example. The screening of phage antibody libraries is generally described, for example, by Harrison et al. (1996) *Meth. Enzymol.* 267: 83-109.

Screening is commonly performed using purified antigen immobilized on a solid support, for example, plastic tubes or wells, or on a chromatography matrix, for example Sepharose™ (Pharmacia). Screening or selection can also be performed on complex antigens, such as the surface of cells (Marks et al. (1993) *BioTechnology* 11: 1145; de Kruif et al. (1995) *Proc. Natl. Acad. Sci. U.S.A.* 92: 3938). Another alternative involves selection by binding biotinylated antigen in solution, followed by capture on streptavidin-coated beads.

In one aspect, panning is performed by immobilizing antigen (generic or specific) on tubes or wells in a plate, e.g., Nunc MAXISORP™ immunotube 8 well strips. Wells are coated with 150 µl of antigen (100 µg/ml in PBS) and incubated overnight. The wells are then washed 3 times with PBS and blocked with 400 µl PBS-2% skim milk (2% MPBS) at 37° C. for 2 hr. The wells are rinsed 3 times with PBS and phage are added in 2% MPBS. The mixture is incubated at room temperature for 90 minutes and the liquid, containing unbound phage, is removed. Wells are rinsed 10 times with PBS-0.1% Tween 20, and then 10 times with PBS to remove detergent. Bound phage are eluted by adding 200 µl of freshly prepared 100 mM triethylamine, mixing well and incubating for 10 min at room temperature. Eluted phage are transferred to a tube containing 100 µl of 1 M Tris-HCl, pH 7.4 and vortexed to neutralize the triethylamine. Exponentially-growing E. coli host cells (e.g., TG1) are infected with, for example, 150 ml of the eluted phage by incubating for 30 min at 37° C. Infected cells are spun down, resuspended in fresh medium and plated in top agarose. Phage plaques are eluted or picked into fresh cultures of host cells to propagate for analysis or for further rounds of selection. One or more rounds of plaque purification are performed if necessary to ensure pure populations of selected phage. Other screening approaches are described by Harrison et al. (1996) supra.

Following identification of phage expressing a domain antibody that binds a desired target, if a phagemid vector such as pHEN1 has been used, the variable domain fusion proteins are easily produced in soluble form by infecting non-suppressor strains of bacteria, e.g., HB2151 that permit the secretion of soluble gene III fusion protein. If a GAS1 secretion signal peptide is encoded by the vector, the fusion polypeptide can be secreted by eukaryotic (e.g., yeast or mammalian) or prokaryotic (e.g., *E. coli*) cells. Alternatively, the V domain sequence can be sub-cloned into an appropriate expression vector to produce soluble protein according to methods known in the art.

3.4. Purification and Concentration of Domain Antibodies

Domain antibodies secreted into the periplasmic space or into the medium of bacteria are harvested and purified according to known methods (Harrison et al. (1996) supra). Skerra & Pluckthun (1988) *Science* 240: 1038 and Breitling et al. (1991) *Gene* 104: 147 describe the harvest of domain antibodies from the periplasm, and Better et al. (1988) *Science* 240: 1041 describes harvest from the culture supernatant. For some domain antibodies, purification can also be achieved by binding to generic ligands, such as protein A or Protein L. Alternatively, the variable domains can be expressed with a peptide tag, e.g., the Myc, HA or 6×-His tags (SEQ ID NO: 644), which facilitate purification by affinity chromatography.

If necessary, domain antibodies are concentrated by any of several methods well known in the art, including, for example, ultrafiltration, diafiltration and tangential flow filtration. The process of ultrafiltration uses semi-permeable membranes and pressure to separate molecular species on the basis of size and shape. The pressure is provided by gas pressure or by centrifugation. Commercial ultrafiltration products are widely available, e.g., from Millipore (Bedford, Mass.; examples include the Centricon™ and Microcon™ concentrators) and Vivascience (Hannover, Germany; examples include the Vivaspin™ concentrators). By selection of a molecular weight cutoff smaller than the target polypeptide (usually ⅓ to ⅙ the molecular weight of the target polypeptide, although differences of as little as 10 kD can be used successfully), the polypeptide is retained when solvent and smaller solutes pass through the membrane. Thus, a molecular weight cutoff of about 5 kD is useful for concentration of domain antibodies described herein.

Diafiltration, which uses ultrafiltration membranes with a "washing" process, is used where it is desired to remove or exchange the salt or buffer in a polypeptide preparation. The polypeptide is concentrated by the passage of solvent and small solutes through the membrane, and remaining salts or buffer are removed by dilution of the retained polypeptide with a new buffer or salt solution or water, as desired, accompanied by continued ultrafiltration. In continuous diafiltration, new buffer is added at the same rate that filtrate passes through the membrane. A diafiltration volume is the volume of polypeptide solution prior to the start of diafiltration—using continuous diafiltration, greater than 99.5% of a fully permeable solute can be removed by washing through six diafiltration volumes with the new buffer. Alternatively, the process can be performed in a discontinuous manner, wherein the sample is repeatedly diluted and then filtered back to its original volume to remove or exchange salt or buffer and ultimately concentrate the polypeptide. Equipment for diafiltration and detailed methodologies for its use are available, for example, from Pall Life Sciences (Ann Arbor, Mich.) and Sartorius AG/Vivascience (Hannover, Germany).

Tangential flow filtration (TFF), also known as "cross-flow filtration," also uses ultrafiltration membrane. Fluid containing the target polypeptide is pumped tangentially along the surface of the membrane. The pressure causes a portion of the fluid to pass through the membrane while the target polypeptide is retained above the filter. In contrast to standard ultrafiltration, however, the retained molecules do not accumulate on the surface of the membrane, but are carried along by the tangential flow. The solution that does not pass through the filter (containing the target polypeptide) can be repeatedly circulated across the membrane to achieve the desired degree of concentration. Equipment for TFF and detailed methodologies for its use are available, for example, from Millipore (e.g., the ProFlux M12™ Benchtop TFF system and the Pellicon™ systems), Pall Life Sciences (e.g., the Minim™ Tangential Flow Filtration system).

Protein concentration is measured in a number of ways that are well known in the art. These include, for example, amino acid analysis, absorbance at 280 nm, the "Bradford" and "Lowry" methods, and SDS-PAGE. The most accurate method is total hydrolysis followed by amino acid analysis by HPLC, concentration is then determined then comparison with the known sequence of the domain antibody. While this method is the most accurate, it is expensive and time-consuming. Protein determination by measurement of UV absorbance at 280 nm faster and much less expensive, yet relatively accurate and is a compromise over amino acid analysis. Absorbance at 280 nm was used to determine protein concentrations reported in the Examples described herein.

"Bradford" and "Lowry" protein assays (Bradford (1976) *Anal. Biochem.* 72: 248-254; Lowry et al. (1951) *J. Biol. Chem.* 193: 265-275) compare sample protein concentration to a standard curve most often based on bovine serum albumin (BSA). These methods are less accurate, tending to underestimate the concentration of domain antibodies. Their accuracy could be improved, however, by using a $V_H$ or $V_\kappa$ single domain polypeptide as a standard.

An additional protein assay method that can be utilized is the bicinchoninic acid assay described in U.S. Pat. No. 4,839,295 (incorporated herein by reference) and marketed by Pierce Biotechnology (Rockford, Ill.) as the "BCA Protein Assay" (e.g., Pierce Catalog No. 23227).

The SDS-PAGE method uses gel electrophoresis and Coomassie Blue staining in comparison to known concentration standards, e.g., known amounts of a domain antibody. Quantitation can be done by eye or by densitometry.

Domain antibodies described herein retain solubility at high concentration (e.g., at least 4.8 mg (~400 μM) in aqueous solution (e.g., PBS), and in an aspect, at least about 5 mg/ml (~417 μM), 10 mg/ml (~833 μM), 20 mg/ml (~1.7 mM), 25 mg/ml (~2.1 mM), 30 mg/ml (~2.5 mM), 35 mg/ml (~2.9 mM), 40 mg/ml (~3.3 mM), 45 mg/ml (~3.75 mM), 50 mg/ml (~4.2 mM), 55 mg/ml (~4.6 mM), 60 mg/ml (~5.0 mM), 65 mg/ml (~5.4 mM), 70 mg/ml (~5.8 mM), 75 mg/ml (~6.3 mM), 100 mg/ml (~8.33 mM), 150 mg/ml (~12.5 mM), 200 mg/ml (~16.7 mM), 240 mg/ml (~20 mM) or higher). One structural feature that promotes high solubility is the relatively small size of the domain antibodies. A full length conventional four chain antibody, e.g., IgG is about 150 kD in size. In contrast, domain antibodies, which have a general structure comprising 4 framework (FW) regions and 3 CDRs, have a size of approximately 12 kD, or less than 1/10 the size of a conventional antibody. Similarly, domain antibodies are approximately half the size of a scFv molecule (~26 kD), and approximately one-fifth the size of a Fab molecule (~60 kD). The size of a domain antibody-containing structure disclosed herein may be 100 kD or less, including structures of, for example, about 90 kD or less, 80 kD or less, 70 kD or less, 60 kD or less, 50 kD or less, 40 kD or less, 30 kD or less, 20 kD or less, down to and including about 12 kD, or a domain antibody in isolation.

The solubility of a domain antibody is primarily determined by the interactions of the amino acid side chains with the surrounding solvent. Hydrophobic side chains tend to be localized internally as a polypeptide folds, away from the solvent-interacting surfaces of the polypeptide. Conversely, hydrophilic residues tend to be localized at the solvent-interacting surfaces of a polypeptide. Generally, polypeptides having a primary sequence that permits the molecule to fold to expose more hydrophilic residues to the aqueous environment are more soluble than one that folds to expose fewer hydrophilic residues to the surface. Thus, the arrangement and number of hydrophobic and hydrophilic residues is an important determinant of solubility. Other parameters that determine polypeptide solubility include solvent pH, temperature, and ionic strength. In a common practice, the solubility of polypeptides can be maintained or enhanced by the addition of glycerol (e.g., ~10% v/v) to the solution.

As discussed above, specific amino acid residues have been identified in conserved residues of human $V_H$ domains that vary in the $V_H$ domains of camelid species, which are generally more soluble than human $V_H$ domains. These include, for example, Gly 44 (Glu in camelids), Leu 45 (Arg in camelids) and Trp 47 (Gly in camelids). Amino acid residue 103 of $V_H$ is also implicated in solubility, with mutation from Trp to Arg tending to confer increased $V_H$ solubility.

In some aspects as set forth herein, domain antibodies are based on the DP47 germline $V_H$ gene segment or the DPK9 germline $V_\kappa$ gene segment. Thus, these germline gene segments are capable, particularly when diversified at selected structural locations described herein, of producing specific binding domain antibodies that are highly soluble. In particular, the four framework regions, which are, in an aspect, not diversified, can contribute to the high solubility of the resulting proteins.

It is expected that a domain antibody that shares a percent sequence identity with one having a known high solubility will also tend to be highly soluble. Thus, as one means of prediction or recognition that a given domain antibody would have the high solubility recited herein, one can compare the sequence of a domain antibody to one or more domain antibodies having known solubility. Thus, when a domain antibody is identified that has high binding affinity but unknown solubility, comparison of its amino acid sequence with that of one or more (in an aspect, more) domain antibodies known to have high solubility (e.g., a dAb sequence disclosed herein) can permit prediction of its solubility. While it is not an absolute predictor, where there is a high degree of similarity to a known highly soluble sequence, e.g., 90-95% or greater similarity, and particularly where there is a high degree of similarity with respect to hydrophilic amino acid residues, or residues likely to be exposed at the solvent interface, it is more likely that a newly identified binding polypeptide will have solubility similar to that of the known highly soluble sequence.

Molecular modeling software can also be used to predict the solubility of a polypeptide sequence relative to that of a polypeptide of known solubility. For example, the substitution or addition of a hydrophobic residue at the solvent-exposed surface, relative to a molecule of known solubility that has a less hydrophobic or even hydrophilic residue exposed in that position is expected to decrease the relative solubility of the polypeptide. Similarly, the substitution or addition of a more hydrophilic residue at such a location is expected to increase the relative solubility. That is, a change in the net number of hydrophilic or hydrophobic residues located at the surface of the molecule (or the overall hydrophobic or hydrophilic nature of the surface-exposed residues) relative to a domain antibody structure with known solubility can predict the relative solubility of a domain antibody.

Alternatively, or in conjunction with such prediction, one can determine limits of a domain antibody's solubility by simply concentrating the polypeptide.

3.5. Affinity Determination

Isolated domain antibody-containing polypeptides as described herein, in an aspect, have affinities (dissociation constant, $K_d = K_{off}/K_{on}$) of at least about 500 nM or less, and in an aspect, at least about 400 nM-50 pM, 300 nM-50 pM, 200 nM-50 pM, and in a further aspect, at least 100 nM-50 pM, 75 nM-50 pM, 50 nM-50 pM, 25 nM-50 pM, 10 nM-50 pM, 5 nM-50 pM, 1 nM-50 pM, 950 pM-50 pM, 900 pM-50 pM, 850 pM-50 pM, 800 pM-50 pM, 750 pM-50 pM, 700 pM-50 pM, 650 pM-50 pM, 600 pM-50 pM, 550 pM-50 pM, 500 pM-50 pM, 450 pM-50 pM, 400 pM-50 pM, 350 pM-50 pM, 300 pM-50 pM, 250 pM-50 pM, 200 pM-50 pM, 150 pM-50 pM, 100 pM-50 pM, 90 pM-50 pM, 80 pM-50 pM, 70 pM-50 pM, 60 pM-50 pM, or even as low as 50 pM.

In another embodiment, the domain antibody inhibits binding of CD28 to CD80 with an $IC_{50}$ in the range of 1 pM to 1.5 pM, inclusive; $IC_{50}$ for inhibition of CD28 binding to CD80. The $IC_{50}$ can be in the range of 1 pM to 1 pM, 1 pM to 900 nM, 1 pM to 800 nM, 1 pM to 700 nM, 1 pM to 600 nM, 1 pM to 500 nM, 1 pM to 400 nM, 1 pM to 300 nM, 1 pM to 200 nM, 1 pM to 100 nM, 1 pM to 50 nM, 1 pM to 10 nM, 1 pM to 1 nM, 1 pM to 500 pM, 1 pM to 100 pM, 1 pM to 50 pM, 1 pM to 10 pM, or 1 pM to 5 pM. Further acceptable ranges include, for example, 50 pM to 1 µM, 100 pM to 500 nM, 125 pM to 250 nM, 150 pM to 200 nM, 150 pM to 100 nM, and 200 pM to 50 nM.

In another embodiment, the domain antibody inhibits binding of CD28 to CD86 with an $IC_{50}$ in the range of 1 pM to 1.5 µM, inclusive; $IC_{50}$ for inhibition of CD28 binding to CD86. The $IC_{50}$ can be in the range of 1 pM to 1 µM, 1 pM to 900 nM, 1 pM to 800 nM, 1 pM to 700 nM, 1 pM to 600 nM, 1 pM to 500 nM, 1 pM to 400 nM, 1 pM to 300 nM, 1 pM to 200 nM, 1 pM to 100 nM, 1 pM to 50 nM, 1 pM to 10 nM, 1 pM to 1 nM, 1 pM to 500 pM, 1 pM to 100 pM, 1 pM to 50 pM, 1 pM to 10 pM, or 1 pM to 5 pM. Further acceptable ranges include, for example, 50 pM to 1 µM, 100 pM to 500 nM, 125 pM to 250 nM, 150 pM to 200 nM, 150 pM to 100 nM, and 200 pM to 50 nM.

The antigen-binding affinity of a domain antibody can be conveniently measured by Surface Plasmon Resonance (SPR) using the BIAcore system (Pharmacia Biosensor, Piscataway, N.J.). In this method, antigen is coupled to the BIAcore chip at known concentrations, and variable domain polypeptides are introduced. Specific binding between the variable domain polypeptide and the immobilized antigen results in increased protein concentration on the chip matrix and a change in the SPR signal. Changes in SPR signal are recorded as resonance units (RU) and displayed with respect to time along the Y axis of a sensorgram. Baseline signal is taken with solvent alone (e.g., PBS) passing over the chip. The net difference between baseline signal and signal after completion of domain antibody injection represents the binding value of a given sample. To determine the off rate ($K_{off}$), on rate ($K_{on}$) and dissociation rate ($K_d$) constants, BIAcore kinetic evaluation software (e.g., version 2.1) is used.

Thus, SPR can be used to monitor antagonism of CD28 binding to CD80 or CD86 by a domain antibody preparation by measuring the displacement or inhibition of binding of CD28 to CD80 or CD86 caused the monovalent antibody preparation. SPR can also be used to monitor the dimerization, or in an aspect, the lack of dimerization, occurring via Fc region in antibody preparations as described herein.

High affinity is dependent upon the complementarity between a surface of the antigen and the CDRs of the antibody or antibody fragment. Complementarity is determined by the type and strength of the molecular interactions possible between portions of the target and the CDR, for example, the potential ionic interactions, van der Waals attractions, hydrogen bonding or other interactions that can occur. CDR3 tends to contribute more to antigen binding interactions than CDRs 1 and 2, probably due to its generally larger size, which provides more opportunity for favorable surface interactions. (See, e.g., Padlan et al. (1994) *Mol. Immunol.* 31: 169-217; Chothia & Lesk (1987) *J. Mol. Biol.* 196: 904-917; and Chothia et al. (1985) *J. Mol. Biol.* 186: 651-663.) High affinity indicates domain antibody/antigen pairings that have a high degree of complementarity, which is directly related to the structures of the variable domain and the target.

In one aspect, a domain antibody is linked to another domain antibody to form a heterodimer in which each individual domain antibody is capable of binding a different cognate antigen. Fusing domain antibodies as heterodimers, wherein each monomer binds a different target antigen, can produce a dual-specific ligand capable, for example, of bridging the respective target antigens. Such dual specific ligands may be used to target cytokines and other molecules which cooperate synergistically in therapeutic situations in the body of an organism. Thus, there is provided a method for synergizing the activity of two or more cytokines, comprising administering a dual specific antibody heterodimer capable of binding to the two or more cytokines.

Domain antibodies set forth herein include CD28-binding domain antibody clones, and clones with substantial sequence similarity or percent identity to them that also bind target antigen with high affinity. As used herein, "substantial" sequence similarity or identity is at least 70% similarity or identity.

An additional measure of identity or similarity is the ability to hybridize under highly stringent hybridization conditions. Thus, a first sequence encoding a domain antibody is substantially similar to a second coding sequence if the first sequence hybridizes to the second sequence (or its complement) under highly stringent hybridization conditions (such as those described by Sambrook et al., Molecular Cloning, Laboratory Manuel, Cold Spring, Harbor Laboratory press, New York). "Highly stringent hybridization conditions" refer to hybridization in 6×SSC at about 45° C., followed by one or more washes in 0.2×SSC, 0.1% SDS at 65° C. "Very highly stringent hybridization conditions" refer to hybridization in 0.5M sodium phosphate, 7% SDS at 65° C., followed by one or more washes at 0.2×SSC, 1% SDS at 65° C.

In an embodiment, domain antibodies include:
1 h-239-850 (SEQ ID NO:58)
1 h-35 (SEQ ID NO:59)
1 h-36 (SEQ ID NO:60)
1 h-79 (SEQ ID NO:61)
1 h-80 (SEQ ID NO:62)
1 h-83 (SEQ ID NO:63)
1 h-108 (SEQ ID NO:64)
1 h-203 (SEQ ID NO:65)
1 h-207 (SEQ ID NO:66)
1 h-238 (SEQ ID NO:67)
1 h-239 (SEQ ID NO:68)
1 h-18-1 (SEQ ID NO:69)
1 h-18-2 (SEQ ID NO:70)
1 h-18-3 (SEQ ID NO:71)
1 h-18-4 (SEQ ID NO:72)
1 h-18-5 (SEQ ID NO:73)
1 h-18-6 (SEQ ID NO:74)
1 h-28-1 (SEQ ID NO:75)
1 h-28-2 (SEQ ID NO:76)
1 h-31 (SEQ ID NO:77)
1 h-32 (SEQ ID NO:78)
1 h-33 (SEQ ID NO:79)
1 h-34 (SEQ ID NO:80)
1 h-35 (SEQ ID NO:81)
1 h-35-15 (SEQ ID NO:82)
1 h-35-2 (SEQ ID NO:83)
1 h-35-5 (SEQ ID NO:84)
1 h-35-7 (SEQ ID NO:85)
1 h-35-9 (SEQ ID NO:86)
1 h-36 (SEQ ID NO:87)
1 h-36-1 (SEQ ID NO:88)
1 h-36-2 (SEQ ID NO:89)
1 h-36-3 (SEQ ID NO:90)
1 h-36-4 (SEQ ID NO:91)
1 h-36-5 (SEQ ID NO:92)
1 h-36-6 (SEQ ID NO:93)
1 h-36-7 (SEQ ID NO:94)
1 h-38 (SEQ ID NO:95)
1 h-39 (SEQ ID NO:96)
1 h-69 (SEQ ID NO:97)
1 h-70 (SEQ ID NO:98)
1 h-71 (SEQ ID NO:99)
1 h-72 (SEQ ID NO:100)
1 h-73 (SEQ ID NO:101)
1 h-74 (SEQ ID NO:102)
1 h-75 (SEQ ID NO:103)
1 h-76 (SEQ ID NO:104)
1 h-77 (SEQ ID NO:105)
1 h-78 (SEQ ID NO:106)
1 h-79 (SEQ ID NO:107)
1 h-79-1 (SEQ ID NO:108)
1 h-79-10 (SEQ ID NO:109)
1 h-79-11 (SEQ ID NO:110)
1 h-79-15 (SEQ ID NO:111)
1 h-79-1505 (SEQ ID NO:112)
1 h-79-1512 (SEQ ID NO:113)
1 h-79-1519 (SEQ ID NO:114)
1 h-79-1520 (SEQ ID NO:115)
1 h-79-16 (SEQ ID NO:116)
1 h-79-17 (SEQ ID NO:117)
1 h-79-18 (SEQ ID NO:118)
1 h-79-19 (SEQ ID NO:119)
1 h-79-2 (SEQ ID NO:120)
1 h-79-20 (SEQ ID NO:121)
1 h-79-21 (SEQ ID NO:122)
1 h-79-22 (SEQ ID NO:123)
1 h-79-23 (SEQ ID NO:124)
1 h-79-24 (SEQ ID NO:125)
1 h-79-25 (SEQ ID NO:126)
1 h-79-26 (SEQ ID NO:127)
1 h-79-27 (SEQ ID NO:128)
1 h-79-28 (SEQ ID NO:129)
1 h-79-29 (SEQ ID NO:130)
1 h-79-3 (SEQ ID NO:131)
1 h-79-30 (SEQ ID NO:132)
1 h-79-31 (SEQ ID NO:133)
1 h-79-32 (SEQ ID NO:134)
1 h-79-4 (SEQ ID NO:135)
1 h-79-5 (SEQ ID NO:136)
1 h-79-6 (SEQ ID NO:137)
1 h-79-7 (SEQ ID NO:138)
1 h-79-8 (SEQ ID NO:139)
1 h-79-801 (SEQ ID NO:140)
1 h-79-802 (SEQ ID NO:141)
1 h-79-803 (SEQ ID NO:142)
1 h-79-804 (SEQ ID NO:143)

1 h-79-805 (SEQ ID NO:144)
1 h-79-806 (SEQ ID NO:145)
1 h-79-807 (SEQ ID NO:146)
1 h-79-808 (SEQ ID NO:147)
1 h-79-809 (SEQ ID NO:148)
1 h-79-810 (SEQ ID NO:149)
1 h-79-811 (SEQ ID NO:150)
1 h-79-812 (SEQ ID NO:151)
1 h-79-813 (SEQ ID NO:152)
1 h-79-814 (SEQ ID NO:153)
1 h-79-815 (SEQ ID NO:154)
1 h-79-9 (SEQ ID NO:155)
1 h-80 (SEQ ID NO:156)
1 h-80-1 (SEQ ID NO:157)
1 h-80-10 (SEQ ID NO:158)
1 h-80-11 (SEQ ID NO:159)
1 h-80-12 (SEQ ID NO:160)
1 h-80-2 (SEQ ID NO:161)
1 h-80-3 (SEQ ID NO:162)
1 h-80-4 (SEQ ID NO:163)
1 h-80-5 (SEQ ID NO:164)
1 h-80-6 (SEQ ID NO:165)
1 h-80-7 (SEQ ID NO:166)
1 h-80-8 (SEQ ID NO:167)
1 h-80-9 (SEQ ID NO:168)
1 h-81 (SEQ ID NO:169)
1 h-82 (SEQ ID NO:170)
1 h-83 (SEQ ID NO:171)
1 h-84 (SEQ ID NO:172)
1 h-85 (SEQ ID NO:173)
1 h-86 (SEQ ID NO:174)
1 h-87 (SEQ ID NO:175)
1 h-88 (SEQ ID NO:176)
1 h-89 (SEQ ID NO:177)
1 h-90 (SEQ ID NO:178)
1 h-107 (SEQ ID NO:179)
1 h-108 (SEQ ID NO:180)
1 h-108-1 (SEQ ID NO:181)
1 h-108-10 (SEQ ID NO:182)
1 h-108-11 (SEQ ID NO:183)
1 h-108-12 (SEQ ID NO:184)
1 h-108-2 (SEQ ID NO:185)
1 h-108-3 (SEQ ID NO:186)
1 h-108-4 (SEQ ID NO:187)
1 h-108-5 (SEQ ID NO:188)
1 h-108-6 (SEQ ID NO:189)
1 h-108-7 (SEQ ID NO:190)
1 h-108-8 (SEQ ID NO:191)
1 h-108-9 (SEQ ID NO:192)
1 h-109 (SEQ ID NO:193)
1 h-110 (SEQ ID NO:194)
1 h-111 (SEQ ID NO:195)
1 h-116 (SEQ ID NO:196)
1 h-200 (SEQ ID NO:197)
1 h-201 (SEQ ID NO:198)
1 h-202 (SEQ ID NO:199)
1 h-203 (SEQ ID NO:200)
1 h-203-1 (SEQ ID NO:201)
1 h-203-2 (SEQ ID NO:202)
1 h-203-3 (SEQ ID NO:203)
1 h-204 (SEQ ID NO:204)
1 h-205 (SEQ ID NO:205)
1 h-207 (SEQ ID NO:206)
1 h-208 (SEQ ID NO:207)
1 h-209 (SEQ ID NO:208)
1 h-217 (SEQ ID NO:209)
1 h-218 (SEQ ID NO:210)
1 h-219 (SEQ ID NO:211)
1 h-220 (SEQ ID NO:212)
1 h-221 (SEQ ID NO:213)
1 h-223 (SEQ ID NO:214)
1 h-225 (SEQ ID NO:215)
1 h-227 (SEQ ID NO:216)
1 h-228 (SEQ ID NO:217)
1 h-229 (SEQ ID NO:218)
1 h-231 (SEQ ID NO:219)
1 h-232 (SEQ ID NO:220)
1 h-233 (SEQ ID NO:221)
1 h-234 (SEQ ID NO:222)
1 h-235 (SEQ ID NO:223)
1 h-236 (SEQ ID NO:224)
1 h-237 (SEQ ID NO:225)
1 h-238 (SEQ ID NO:226)
1 h-239 (SEQ ID NO:227)
1 h-239-8 (SEQ ID NO:228)
1 h-239-804 (SEQ ID NO:229)
1 h-239-807 (SEQ ID NO:230)
1 h-239-809 (SEQ ID NO:231)
1 h-239-815 (SEQ ID NO:232)
1 h-239-816 (SEQ ID NO:233)
1 h-239-817 (SEQ ID NO:234)
1 h-239-819 (SEQ ID NO:235)
1 h-239-824 (SEQ ID NO:236)
1 h-239-828 (SEQ ID NO:237)
1 h-239-829 (SEQ ID NO:238)
1 h-239-832 (SEQ ID NO:239)
1 h-239-833 (SEQ ID NO:240)
1 h-239-837 (SEQ ID NO:241)
1 h-239-838 (SEQ ID NO:242)
1 h-239-840 (SEQ ID NO:243)
1 h-239-847 (SEQ ID NO:244)
1 h-239-849 (SEQ ID NO:245)
1 h-239-850 (SEQ ID NO:246)
1 h-239-851 (SEQ ID NO:247)
1 h-239-856 (SEQ ID NO:248)
1 h-239-857 (SEQ ID NO:249)
1 h-239-859 (SEQ ID NO:250)
1 h-239-861 (SEQ ID NO:251)
1 h-239-862 (SEQ ID NO:252)
1 h-239-863 (SEQ ID NO:253)
1 h-239-864 (SEQ ID NO:254)
1 h-239-869 (SEQ ID NO:255)
1 h-239-870 (SEQ ID NO:256)
1 h-239-871 (SEQ ID NO:257)
1 h-239-872 (SEQ ID NO:258)
1 h-239-873 (SEQ ID NO:259)
1 h-239-874 (SEQ ID NO:260)
1 h-239-875 (SEQ ID NO:261)
1 h-239-876 (SEQ ID NO:262)
1 h-239-877 (SEQ ID NO:263)
1 h-239-879 (SEQ ID NO:264)
1 h-239-880 (SEQ ID NO:265)
1 h-239-881 (SEQ ID NO:266)
1 h-239-882 (SEQ ID NO:267)
1 h-239-883 (SEQ ID NO:268)
1 h-239-885 (SEQ ID NO:269)
1 h-239-886 (SEQ ID NO:270)
1 h-239-887 (SEQ ID NO:472)
1 h-239-888 (SEQ ID NO:473)
1 h-239-889 (SEQ ID NO:474)
1 h-239-890 (SEQ ID NO:475)
1 h-239-891 (SEQ ID NO:476)
1 h-239-892 (SEQ ID NO:477)
1 h-239-893 (SEQ ID NO:478)

1 h-239-894 (SEQ ID NO:479)
1 h-239-895 (SEQ ID NO:480)
1 h-239-896 (SEQ ID NO:481)
1 h-239-897 (SEQ ID NO:482)
1 h-239-898 (SEQ ID NO:483)
1 h-239-9 (SEQ ID NO:271)
1 h-112 (SEQ ID NO:397)
1 h-99-237 (SEQ ID NO:272)
1 h-99-238 (SEQ ID NO:273)
1 h-37 (SEQ ID NO:274)
1 h-93 (SEQ ID NO:275)
1 h-99 (SEQ ID NO:276)
1 h-4-1 (SEQ ID NO:277)
1 h-4-2 (SEQ ID NO:278)
1 h-4-3 (SEQ ID NO:279)
1 h-4-4 (SEQ ID NO:280)
1 h-29 (SEQ ID NO:281)
1 h-30 (SEQ ID NO:282)
1 h-37 (SEQ ID NO:283)
1 h-40 (SEQ ID NO:284)
1 h-91 (SEQ ID NO:285)
1 h-92 (SEQ ID NO:286)
1 h-93 (SEQ ID NO:287)
1 h-93-1 (SEQ ID NO:288)
1 h-93-2 (SEQ ID NO:289)
1 h-93-201 (SEQ ID NO:290)
1 h-93-204 (SEQ ID NO:291)
1 h-94 (SEQ ID NO:292)
1 h-95 (SEQ ID NO:293)
1 h-96 (SEQ ID NO:294)
1 h-97 (SEQ ID NO:295)
1 h-98 (SEQ ID NO:296)
1 h-99 (SEQ ID NO:297)
1 h-99-1 (SEQ ID NO:298)
1 h-99-2 (SEQ ID NO:299)
1 h-99-201 (SEQ ID NO:300)
1 h-99-202 (SEQ ID NO:301)
1 h-99-203 (SEQ ID NO:302)
1 h-99-204 (SEQ ID NO:303)
1 h-99-205 (SEQ ID NO:304)
1 h-99-206 (SEQ ID NO:305)
1 h-99-207 (SEQ ID NO:306)
1 h-99-208 (SEQ ID NO:307)
1 h-99-209 (SEQ ID NO:308)
1 h-99-210 (SEQ ID NO:309)
1 h-99-211 (SEQ ID NO:310)
1 h-99-2112 (SEQ ID NO:311)
1 h-99-2113 (SEQ ID NO:312)
1 h-99-2114 (SEQ ID NO:313)
1 h-99-2115 (SEQ ID NO:314)
1 h-99-2116 (SEQ ID NO:315)
1 h-99-212 (SEQ ID NO:316)
1 h-99-213 (SEQ ID NO:317)
1 h-99-214 (SEQ ID NO: 640)
1 h-99-215 (SEQ ID NO:318)
1 h-99-216 (SEQ ID NO:319)
1 h-99-217 (SEQ ID NO:320)
1 h-99-218 (SEQ ID NO:321)
1 h-99-219 (SEQ ID NO:322)
1 h-99-220 (SEQ ID NO:323)
1 h-99-221 (SEQ ID NO:324)
1 h-99-222 (SEQ ID NO:325)
1 h-99-223 (SEQ ID NO:326)
1 h-99-224 (SEQ ID NO:327)
1 h-99-225 (SEQ ID NO:328)
1 h-99-226 (SEQ ID NO:329)
1 h-99-227 (SEQ ID NO:330)
1 h-99-228 (SEQ ID NO:331)
1 h-99-229 (SEQ ID NO:332)
1 h-99-230 (SEQ ID NO:333)
1 h-99-231 (SEQ ID NO:334)
1 h-99-232 (SEQ ID NO:335)
1 h-99-233 (SEQ ID NO:336)
1 h-99-234 (SEQ ID NO:337)
1 h-99-235 (SEQ ID NO:338)
1 h-99-236 (SEQ ID NO:339)
1 h-99-237 (SEQ ID NO:340)
1 h-99-238 (SEQ ID NO:341)
1 h-99-241 (SEQ ID NO:342)
1 h-99-243 (SEQ ID NO:343)
1 h-99-244 (SEQ ID NO:344)
1 h-99-245 (SEQ ID NO:345)
1 h-99-246 (SEQ ID NO:346)
1 h-99-247 (SEQ ID NO:347)
1 h-99-248 (SEQ ID NO:348)
1 h-99-249 (SEQ ID NO:349)
1 h-99-250 (SEQ ID NO:350)
1 h-99-251 (SEQ ID NO:351)
1 h-99-252 (SEQ ID NO:352)
1 h-99-253 (SEQ ID NO:353)
1 h-99-254 (SEQ ID NO:354)
1 h-99-255 (SEQ ID NO:355)
1 h-99-256 (SEQ ID NO:356)
1 h-99-257 (SEQ ID NO:357)
1 h-99-258 (SEQ ID NO:358)
1 h-99-259 (SEQ ID NO:359)
1 h-99-260 (SEQ ID NO:360)
1 h-99-261 (SEQ ID NO:361)
1 h-99-263 (SEQ ID NO:362)
1 h-99-264 (SEQ ID NO:363)
1 h-99-265 (SEQ ID NO:364)
1 h-99-266 (SEQ ID NO:365)
1 h-99-267 (SEQ ID NO:366)
1 h-99-268 (SEQ ID NO:367)
1 h-99-269 (SEQ ID NO:368)
1 h-99-270 (SEQ ID NO:369)
1 h-99-275 (SEQ ID NO:370)
1 h-99-276 (SEQ ID NO:371)
1 h-99-277 (SEQ ID NO:372)
1 h-99-278 (SEQ ID NO:373)
1 h-99-297 (SEQ ID NO:374)
1 h-99-6 (SEQ ID NO:375)
1 h-99-11 (SEQ ID NO:376)
1 h-99-13 (SEQ ID NO:377)
1 h-99-14 (SEQ ID NO:378)
1 h-99-15 (SEQ ID NO:379)
1 h-100 (SEQ ID NO:380)
1 h-101 (SEQ ID NO:381)
1 h-102 (SEQ ID NO:382)
1 h-103 (SEQ ID NO:383)
1 h-104 (SEQ ID NO:384)
1 h-105 (SEQ ID NO:385)
1 h-106 (SEQ ID NO:386)
1 h-113 (SEQ ID NO:387)
1 h-114 (SEQ ID NO:388)
1 h-115 (SEQ ID NO:389)
1 h-117 (SEQ ID NO:390)
1 h-118 (SEQ ID NO:391)
1 h-119 (SEQ ID NO:392)
1 h-212 (SEQ ID NO:393)
1 h-212-1 (SEQ ID NO:394)
1 h-213 (SEQ ID NO:395)
1 h-230 (SEQ ID NO:396)
1 h-99-262 (SEQ ID NO:398)

1 h-239-89101 (SEQ ID NO:532)
1 h-239-89102 (SEQ ID NO:533)
1 h-239-89103 (SEQ ID NO:534)
1 h-239-89104 (SEQ ID NO:535)
1 h-239-891(Q3C) (SEQ ID NO:536)
1 h-239-891(S9C) (SEQ ID NO:537)
1 h-239-891(R18C) (SEQ ID NO:538)
1 h-239-891(G41C) (SEQ ID NO:539)
1 h-239-891(K42C) (SEQ ID NO:540)
1 h-239-891(K45C) (SEQ ID NO:541)
1 h-239-891(S60C) (SEQ ID NO:542)
1 h-239-891(D70C) (SEQ ID NO:543)
1 h-239-891(T74C) (SEQ ID NO:544)
1 h-239-891(Q79C) (SEQ ID NO:545)
1 h-239-891(K103C) (SEQ ID NO:546)
1 h-239-89201 (SEQ ID NO:547)
1 h-239-89202 (SEQ ID NO:548)
1 h-239-89203 (SEQ ID NO:549)
1 h-239-89204 (SEQ ID NO:550)
1 h-239-89205 (SEQ ID NO:551)
1 h-239-89206 (SEQ ID NO:552)
1 h-239-89207 (SEQ ID NO:553)
1 h-239-89208 (SEQ ID NO:554)
1 h-239-89209 (SEQ ID NO:555)
1 h-239-89210 (SEQ ID NO:556)
1 h-239-89211 (SEQ ID NO:557)
1 h-239-89212 (SEQ ID NO:558)
1 h-239-89213 (SEQ ID NO:559)
1 h-239-89214 (SEQ ID NO:560)
1 h-239-89215 (SEQ ID NO:561)
1 h-239-89216 (SEQ ID NO:562)
1 h-239-89217 (SEQ ID NO:563)
1 h-239-89227 (SEQ ID NO:564)
1 h-239-89228 (SEQ ID NO:565)
1 h-239-89229 (SEQ ID NO:566)
1 h-239-89230 (SEQ ID NO:567)
1 h-239-89231 (SEQ ID NO:568)
1 h-239-89232 (SEQ ID NO:569)
1 h-239-89233 (SEQ ID NO:570)
1 h-239-89234 (SEQ ID NO:571)
1 h-239-89218 (SEQ ID NO:572)
1 h-239-89219 (SEQ ID NO:573)
1 h-239-89220 (SEQ ID NO:574)
1 h-239-89221 (SEQ ID NO:575)
1 h-239-89222 (SEQ ID NO:576)
1 h-239-89223 (SEQ ID NO:577)
1 h-239-89224 (SEQ ID NO:578)
1 h-239-89225 (SEQ ID NO:579)
1 h-239-89226 (SEQ ID NO:580)
1 h-239-89235 (SEQ ID NO:581)
1 h-239-89236 (SEQ ID NO:582)
1 h-239-89237 (SEQ ID NO:583)
1 h-239-89238 (SEQ ID NO:584)
1 h-239-89239 (SEQ ID NO:585)
1 h-239-89240 (SEQ ID NO:586)
1 h-239-89241 (SEQ ID NO:587)
1 h-239-89242 (SEQ ID NO:588)
1 h-239-89243 (SEQ ID NO:589)
1 h-239-89244 (SEQ ID NO:590)
1 h-239-89245 (SEQ ID NO:591)
1 h-239-89246 (SEQ ID NO:592)
1 h-239-89247 (SEQ ID NO:593)
1 h-239-89248 (SEQ ID NO:594)
1 h-239-89249 (SEQ ID NO:595)
1 h-239-89250 (SEQ ID NO:596)
1 h-99-23701 (SEQ ID NO:597)
1 h-99-23702 (SEQ ID NO:598)
1 h-99-23703 (SEQ ID NO:599)
1 h-99-23704 (SEQ ID NO:600)
1 h-99-23705 (SEQ ID NO:601)
1 h-99-23706 (SEQ ID NO:602)
1 h-99-23707 (SEQ ID NO:603)
1 h-99-23708 (SEQ ID NO:604)
1 h-99-23709 (SEQ ID NO:605)
1 h-99-23710 (SEQ ID NO:606)
1 h-99-23711 (SEQ ID NO:607)
1 h-99-23712 (SEQ ID NO:608)
1 h-99-23713 (SEQ ID NO:609)
1 h-99-23714 (SEQ ID NO:610)
1 h-99-23715 (SEQ ID NO:611)
1 h-99-23716 (SEQ ID NO:612)
1 h-99-23717 (SEQ ID NO:613)
1 h-99-23718 (SEQ ID NO:614)
1 h-99-23719 (SEQ ID NO:615)
1 h-99-23720 (SEQ ID NO:616)
1 h-99-23721 (SEQ ID NO:617)
1 h-99-23722 (SEQ ID NO:618)
1 h-99-23723 (SEQ ID NO:619)
1 h-99-23724 (SEQ ID NO:620)
1 h-99-23725 (SEQ ID NO:621)
1 h-99-23726 (SEQ ID NO:622)
1 h-99-23727 (SEQ ID NO:623)
1 h-99-23728 (SEQ ID NO:624)
1 h-99-23729 (SEQ ID NO:625)
1 h-99-23730 (SEQ ID NO:626)
1 h-99-23731 (SEQ ID NO:627)
1 h-99-23732 (SEQ ID NO:628)
1 h-99-23733 (SEQ ID NO:629)
1 h-99-23734 (SEQ ID NO:630)
1 h-99-23735 (SEQ ID NO:631)
1 h-99-23736 (SEQ ID NO:632)
1 h-99-23738 (SEQ ID NO:633)
1 h-99-23739 (SEQ ID NO:634)
1 h-99-23737 (SEQ ID NO:635)

In an embodiment, domain antibodies may include one or more of the following CDRs:

1 h-239-850 CDR1 (SEQ ID NO:484)
1 h-239-850 CDR2 (SEQ ID NO:485)
1 h-239-850 CDR3 (SEQ ID NO:486)
1 h-35 CDR1 (SEQ ID NO:487)
1 h-35 CDR2 (SEQ ID NO:488)
1 h-35 CDR3 (SEQ ID NO:489)
1 h-36 CDR1 (SEQ ID NO:490)
1 h-36 CDR2 (SEQ ID NO:491)
1 h-36 CDR3 (SEQ ID NO:492)
1 h-79 CDR1 (SEQ ID NO:493)
1 h-79 CDR2 (SEQ ID NO:494)
1 h-79 CDR3 (SEQ ID NO:495)
1 h-80 CDR1 (SEQ ID NO:496)
1 h-80 CDR2 (SEQ ID NO:497)
1 h-80 CDR3 (SEQ ID NO:498)
1 h-83 CDR1 (SEQ ID NO:499)
1 h-83 CDR2 (SEQ ID NO:500)
1 h-83 CDR3 (SEQ ID NO:501)
1 h-108 CDR1 (SEQ ID NO:502)
1 h-108 CDR2 (SEQ ID NO:503)
1 h-108 CDR3 (SEQ ID NO:504)
1 h-203 CDR1 (SEQ ID NO:505)
1 h-203 CDR2 (SEQ ID NO:506)
1 h-203 CDR3 (SEQ ID NO:507)
1 h-207 CDR1 (SEQ ID NO:508)
1 h-207 CDR2 (SEQ ID NO:509)
1 h-207 CDR3 (SEQ ID NO:510)
1 h-238 CDR1 (SEQ ID NO:511)

1 h-238 CDR2 (SEQ ID NO:512)
1 h-238 CDR3 (SEQ ID NO:513)
1 h-239 CDR1 (SEQ ID NO:514)
1 h-239 CDR2 (SEQ ID NO:515)
1 h-239 CDR3 (SEQ ID NO:516)
1 h-99-237 CDR1 (SEQ ID NO:517)
1 h-99-237 CDR2 (SEQ ID NO:518)
1 h-99-237 CDR3 (SEQ ID NO:519)
1 h-99-238 CDR1 (SEQ ID NO:520)
1 h-99-238 CDR2 (SEQ ID NO:521)
1 h-99-238 CDR3 (SEQ ID NO:522)
1 h-37 CDR1 (SEQ ID NO:523)
1 h-37 CDR2 (SEQ ID NO:524)
1 h-37 CDR3 (SEQ ID NO:525)
1 h-93 CDR1 (SEQ ID NO:526)
1 h-93 CDR2 (SEQ ID NO:527)
1 h-93 CDR3 (SEQ ID NO:528)
1 h-99 CDR1 (SEQ ID NO:529)
1 h-99 CDR2 (SEQ ID NO:530),
1 h-99 CDR3 (SEQ ID NO:531),
1 h-239-891 CDR1 (SEQ ID NO:636),
1 h-239-891 CDR2 (SEQ ID NO:637), and
1 h-239-891 CDR3 (SEQ ID NO:638).

4. Assays for CD28 Activities

In an exemplary embodiment, a domain antibody as described herein binds to CD28 yet does not substantially agonize CD28 signaling. Activation of the CD28 pathway manifests a number of different outcomes that can be measured in order to assess the effect of a given domain antibody on the activity of the pathway. However, for the assessment of the antagonist or agonist function of domain antibodies described herein, at least one of the following CD28 assays can be used.

In an embodiment, activation of T cells is measured. In the assay, human CD3 positive T cells are stimulated with anti-CD3 plus transfected CHO cells expressing either CD80 or CD86. This results in proliferation of the T cells and is CD28 dependent as domain antibodies block the proliferation response.

In another embodiment, induction of T cell proliferation and induction of cytokine secretion is measured. The assay comprises stimulation of human CD3 positive T cells with anti-CD28 mAb 9.3 (Gibson, et al. (1996) *J. Biol. Chem.,* 271: 7079-7083). This results in up-regulation of T cell receptor-mediated signaling and secretion of cytokines and is CD28-dependent, as mAb 9.3 blocks the proliferation response. Secreted cytokines that may be measured include, but are not limited to, GM-CSF, IL-2, IL-3, IL-4, IL-5, IL-6, IL-10, IL-12 IL-13, IL-15, IL-17, IL-21, IL-22, IL-24, TGFβ, TNF-α, TNF-β, IFN-α, IFN-β, IFN-γ. One or more of such cytokines may be detected and/or measured according to the disclosure set forth herein.

As set forth elsewhere herein, an assay for CD28 activity may also include the assessment of CTLA4 activity. In particular, a domain antibody according to the present disclosure does not inhibit the CTLA-4-mediated inhibition of T cell function, including inhibition of T cell receptor mediated signaling, inhibition of T cell proliferation, and inhibition of cytokine secretion.

It will be understood, based on the disclosure herein, that domain antibodies set forth herein can possess multiple functions and activities, and therefore, may be assayed by multiple distinct assays. As set forth in detail elsewhere herein, domain antibodies have multiple defining characteristics (e.g., CD28 binding affinity, CDR domain identity, and amino acid sequence, among others), and therefore, each distinct domain antibody can be characterized in multiple ways and through multiple parameters. The characterization of each such domain antibody, alone or in conjunction with the activity and/or CD28 binding properties of the domain antibody, can therefore provide unique identifying characteristics for the domain antibody.

5. PEGylation of Domain Antibodies

Also provided herein are PEGylated domain antibodies which have increased half-life and in an aspect, also resistance to degradation without a loss in activity (e.g., binding affinity) relative to non-PEGylated domain antibodies.

Both site-specific and random PEGylation of protein molecules is known in the art (See, for example, Zalipsky and Lee, *Poly(ethylene glycol) Chemistry: Biotechnical and Biomedical Applications* (1992) pp 347-370, Plenum, NY; Goodson and Katre (1990) *Bio/Technology,* 8: 343; Hershfield et al. (1991) *PNAS* 88: 7185). More specifically, random PEGylation of antibody molecules has been described at lysine residues and thiolated derivatives (Ling and Mattiasson (1983) *Immunol. Methods* 59: 327; Wilkinson et al. (1987) *Immunol. Letters,* 15: 17; Kitamura et al. (1991) *Cancer Res.* 51: 4310; Delgado et al. (1996) *Br. J. Cancer,* 73: 175; Pedley et al. (1994) *Br. J. Cancer,* 70: 1126)

Accordingly, domain antibodies according to this aspect can be coupled, using methods known in the art to polymer molecules (in an aspect, PEG) useful for achieving the increased half-life and degradation resistance properties encompassed herein. Polymer moieties which can be utilized can be synthetic or naturally occurring and include, but are not limited to straight or branched chain polyalkylene, polyalkenylene or polyoxyalkylene polymers, or a branched or unbranched polysaccharide such as a homo- or heteropolysaccharide. Examples of synthetic polymers which may be used include straight or branched chain poly(ethylene glycol) (PEG), poly(propylene glycol), or poly(vinyl alcohol) and derivatives or substituted forms thereof. Useful substituted polymers include substituted PEG, including methoxy (polyethylene glycol). Naturally occurring polymer moieties which may be used herein in addition to or in place of PEG include lactose, amylose, dextran, or glycogen, as well as derivatives thereof which would be recognized by one of skill in the art. Derivatized forms of polymer molecules as set forth herein include, for example, derivatives which have additional moieties or reactive groups present therein to permit interaction with amino acid residues of the domain antibodies described herein. Such derivatives include N-hydroxylsuccinimide (NHS) active esters, succinimidyl propionate polymers, and sulfhydryl-selective reactive agents such as maleimide, vinyl sulfone, and thiol. Derivatized polymers include, but are not limited to PEG polymers having the formulae: PEG-O—$CH_2CH_2CH_2$—$CO_2$—NHS; PEG-O—$CH_2$—NHS; PEG-O—$CH_2CH_2$—$CO_2$—NHS; PEG-S—$CH_2CH_2$—CO—NHS; PEG-$O_2$CNH—CH(R)—$CO_2$—NHS; PEG-NHCO—$CH_2CH_2$—CO—NHS; and PEG-O—$CH_2$—$CO_2$—NHS; where R is $(CH_2)_4$NHCO$_2$(mPEG). PEG polymers useful as set forth herein may be linear molecules, or may be branched wherein multiple PEG moieties are present in a single polymer. Useful PEG derivatives include, but are not limited to, mPEG-MAL, mPEG2-MAL, mPEG-(MAL)$^2$, multi-arm PEG, mPEG-SPA, mPEG2-NHS, and mPEG2-(MAL)$^2$, illustrated below:

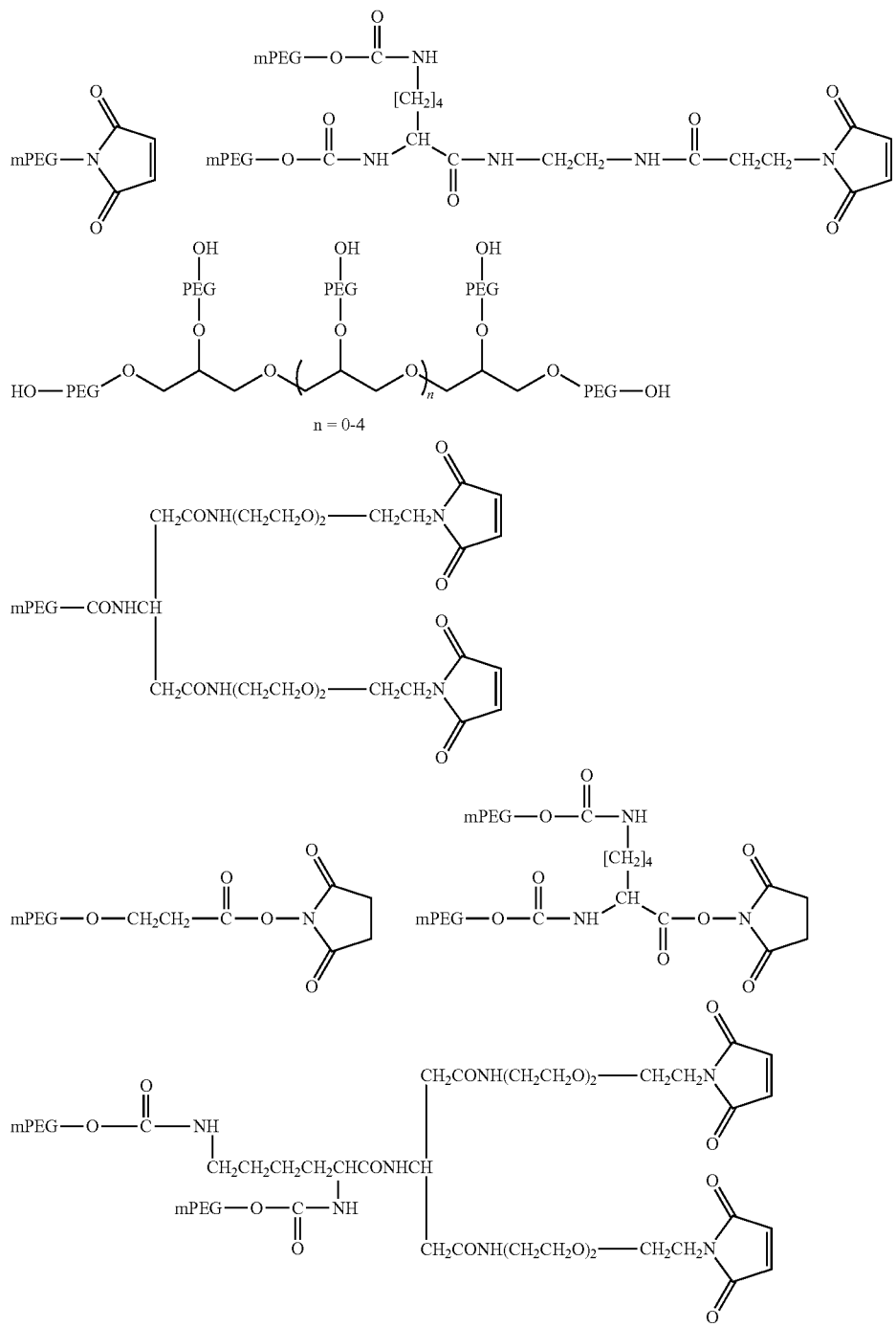

The reactive group (e.g., MAL, NHS, SPA, VS, or Thiol) may be attached directly to the PEG polymer or may be attached to PEG via a linker molecule.

The size of polymers useful as set forth herein can be in the range of between about 500 Da to 60 kD, for example, between about 1000 Da and 60 kD, 10 kD and 60 kD, 20 kD and 60 kD, 30 kD and 60 kD, 40 kD and 60 kD, and up to between 50 kD and 60 kD. The polymers used herein, particularly PEG, can be straight chain polymers or can possess a branched conformation. Depending on the combination of molecular weight and conformation, the polymer molecules useful as set forth herein, when attached to a domain antibody, will yield a molecule having an average hydrodynamic size of between about 24 and 500 kD. The hydrodynamic size of a polymer molecule used herein refers to the apparent size of a molecule (e.g., a protein molecule) based on the diffusion of the molecule through an aqueous solution. The diffusion, or motion of a protein through solution can be processed to derive an apparent size of the protein, where the size is given by the Stokes radius or hydrodynamic radius of the protein particle. The "hydrodynamic size" of a protein depends on both mass and shape (conformation), such that two proteins having the same molecular mass may have differing hydrodynamic sizes based on the overall conformation of the protein. The hydrodynamic size of a PEG-linked domain antibody, e.g., a domain antibody as described herein, can be in the range of about 24 kD to 500 kD; 30 to 500 kD; 40 to 500 kD; 50 to 500 kD; 100 to 500 kD; 150 to 500 kD; 200 to 500 kD; 250 to 500 kD; 300 to 500 kD; 350 to 500 kD; 400 to 500 kD, and 450 to 500 kD. In an exemplary embodiment, the hydrodynamic size of a PEGylated domain antibody as described herein is about 30 to 40 kD; 70 to 80 kD or 200 to 300 kD. The size of a polymer molecule attached to a domain antibody may thus be varied depending upon the desired application. For example, where the PEGylated domain antibody is intended to leave the circulation and enter into peripheral tissues, it is desirable to keep the size of the attached polymer low to facilitate extravazation from the blood stream. Alternatively, where it is desired to have the PEGylated domain antibody remain in the circulation for a longer period of time, a higher molecular weight polymer can be used (e.g., a 30 to 60 kD polymer).

The polymer (PEG) molecules useful as set forth herein can be attached to domain antibodies using methods that are well known in the art. The first step in the attachment of PEG or other polymer moieties to a domain antibody is the substitution of the hydroxyl end-groups of the PEG polymer by electrophile-containing functional groups. Particularly, PEG polymers are attached to either cysteine or lysine residues present in the domain antibody. The cysteine and lysine residues can be naturally occurring, or can be engineered into the domain antibody molecule. For example, cysteine residues can be recombinantly engineered at the C-terminus of domain antibodies, or residues at specific solvent accessible locations in the domain antibody can be substituted with cysteine or lysine. In one embodiment, a PEG moiety is attached to a cysteine residue which is present in the hinge region at the C-terminus of a domain antibody.

In another embodiment a PEG moiety or other polymer is attached to a cysteine or lysine residue which is either naturally occurring at or engineered into the N-terminus of a domain antibody as set forth herein. In a still further embodiment, a PEG moiety or other polymer is attached to a domain antibody as set forth herein at a cysteine or lysine residue (either naturally occurring or engineered) which is at least 2 residues away from (e.g., internal to) the C- and/or N-terminus of the domain antibody.

In one embodiment, the PEG polymer(s) is attached to one or more cysteine or lysine residues present in a framework region (FWs) and one or more heterologous CDRs of a domain antibody. CDRs and framework regions (e.g., CDR1-CDR3 and FW1-FW4) are those regions of domain antibody as defined in the Kabat database of Sequences of Proteins of Immunological Interest (Kabat et al. (1991) *Sequences of Immunological Interest*, 5$^{th}$ ed. U.S. Dept. Health & Human Services, Washington, D.C.). In one embodiment, a PEG polymer is linked to a cysteine or lysine residue in the $V_H$ framework segment DP47, or the $V_κ$ framework segment DPK9. Cysteine and/or lysine residues of DP47 which may be linked to PEG disclosed herein include the cysteine at positions 22, or 96 and the lysine at positions 43, 65, 76, or 98 of SEQ ID NO: 641. Cysteine and/or lysine residues of DPK9 which may be linked to PEG disclosed herein include the cysteine residues at positions 23, or 88 and the lysine residues at positions 39, 42, 45, 103, or 107 of SEQ ID NO: 643. (The DPK9 sequence of SEQ ID NO:641 is 95 amino acids in length; however, it is understood in the art that residues 103 and 107 are provided by the sequence encoded by the J gene segment, when fused to the DPK9 sequence.) In addition, specific cysteine or lysine residues may be linked to PEG in the $V_H$ canonical framework region DP38, or DP45.

In addition, specific solvent accessible sites in the domain antibody which are not naturally occurring cysteine or lysine residues may be mutated to a cysteine or lysine for attachment of a PEG polymer. Solvent accessible residues in any given domain antibody can be determined using methods known in the art such as analysis of the crystal structure of the domain antibody. For example, using the solved crystal structure of the $V_H$ dAb HEL4 (SEQ ID NO: 399; a domain antibody that binds hen egg lysozyme), the residues Gln-13, Pro-14, Gly-15, Pro-41, Gly-42, Lys-43, Asp-62, Lys-65, Arg-87, Ala-88, Glu-89, Gln-112, Leu-115, Thr-117, Ser-119, and Ser-120 have been identified as being solvent accessible, and disclosed herein would be attractive candidates for mutation to cysteine or lysine residues for the attachment of a PEG polymer. In addition, using the solved crystal structure of the $V_k$ dummy domain antibody (SEQ ID NO:400), the residues Val-15, Pro-40, Gly-41, Ser-56, Gly-57, Ser-60, Pro-80, Glu-81, Gln-100, Lys-107, and Arg-108 have been identified as being solvent accessible, and disclosed herein would be attractive candidates for mutation to cysteine or lysine residues for the attachment of a PEG polymer. In one embodiment as disclosed herein, a PEG polymer is linked to multiple solvent accessible cysteine or lysine residues, or to solvent accessible residues which have been mutated to a cysteine or lysine residue. Alternatively, only one solvent accessible residue is linked to PEG, either where the particular domain antibody only possesses one solvent accessible cysteine or lysine (or residue modified to a cysteine or lysine) or where a particular solvent accessible residue is selected from among several such residues for PEGylation.

```
Primary amino acid sequence of HEL4 (SEQ ID NO:
399):
  1 EVQLLESGGG LVQPGGSLRL SCAASGFRIS DEDMGWVRQA
    PGKGLEWVSS

51 IYGPSGSTYY ADSVKGRFTI SRDNSKNTLY LQMNSLRAED
    TAVYYCASAL

101 EPLSEPLGFW GQGTLVTVSS

Primary amino acid sequence of V_k dummy (SEQ ID NO:
400):
  1 DIQMTQSPSS LSASVGDRVT ITCRASQSIS SYLNWYQQKP
    GKAPKLLIYA

51 ASSLQSGVPS RFSGSGSGTD FTLTISSLQP EDFATYYCQQ
    SYSTPNTFGQ

101 GTKVEIKR
```

Several PEG attachment schemes disclosed herein are provided by the company Nektar (San Carlos, Calif.). For example, where attachment of PEG or other polymer to a lysine residue is desired, active esters of PEG polymers which have been derivatized with N-hydroxylsuccinimide, such as succinimidyl propionate may be used. Where attachment to a cysteine residue is intended, PEG polymers which have been derivatized with sulfhydryl-selective reagents such as maleimide, vinyl sulfone, or thiols may be used. Other examples of specific embodiments of PEG derivatives which may be used as disclosed herein to generate PEGylated antibodies can be found in the Nektar Catalog (available on the world wide web at nektar.com). In addition, several derivatized forms of PEG may be used as disclosed herein to facilitate attachment of the PEG polymer to a domain antibody. PEG derivatives disclosed herein include, but are not limited to PEG-succinimidyl succinate, urethane linked PEG, PEG phenylcarbonate, PEG succinimidyl carbonate, PEG-carboxymethyl azide, dimethylmaleic anhydride PEG, PEG dithiocarbonate derivatives, PEG-tresylates (2,2,2-trifluoroethanesolfonates), mPEG imidoesters, and other as described in Zalipsky and Lee, (1992) ("Use of functionalized poly(ethylene glycol)s for modification of peptides" in *Poly(Ethylene Glycol) Chemistry: Biotechnical and Biomedical Applications*, J. Milton Harris, Ed., Plenum Press, NY).

In one embodiment disclosed herein, a domain antibody composition comprises a domain antibody and PEG polymer wherein the ratio of PEG polymer to domain antibody is a molar ratio of at least 0.25:1. In a further embodiment, the molar ratio of PEG polymer to domain antibody is 0.33:1 or greater. In a still further embodiment the molar ratio of PEG polymer to domain antibody is 0.5:1 or greater.

6. Modification of Domain Antibodies 6.1. Diversification of the Canonical Sequence Having selected several known main-chain conformations or, in an aspect, a single known main-chain conformation, ligands disclosed herein or libraries for use herein can be constructed by varying the binding site of the molecule in order to generate a repertoire with structural and/or functional diversity. This means that variants are generated such that they possess sufficient diversity in their structure and/or in their function so that they are capable of providing a range of activities.

The desired diversity is typically generated by varying the selected molecule at one or more positions. The positions to be changed can be chosen at random or are in an aspect, selected. The variation can then be achieved either by randomization, during which the resident amino acid is replaced by any amino acid or analogue thereof, natural or synthetic, producing a very large number of variants or by replacing the resident amino acid with one or more of a defined subset of amino acids, producing a more limited number of variants.

Various methods have been reported for introducing such diversity. Error-prone PCR (Hawkins et al. (1992) *J. Mol. Biol.*, 226: 889), chemical mutagenesis (Deng et al. (1994) *J. Biol. Chem.*, 269: 9533) or bacterial mutator strains (Low et al. (1996) *J. Mol. Biol.*, 260: 359) can be used to introduce random mutations into the genes that encode the molecule. Methods for mutating selected positions are also well known in the art and include the use of mismatched oligonucleotides or degenerate oligonucleotides, with or without the use of PCR. For example, several synthetic antibody libraries have been created by targeting mutations to the antigen binding loops. The H3 region of a human tetanus toxoid-binding Fab has been randomized to create a range of new binding specificities (Barbas et al. (1992) *Proc. Natl. Acad. Sci. USA*, 89: 4457). Random or semi-random H3 and L3 regions have been appended to germline V gene segments to produce large libraries with unmutated framework regions (Hoogenboom & Winter (1992) *J. Mol. Biol.*, 227: 381; Barbas et al. (1992) *Proc. Natl. Acad. Sci. USA*, 89: 4457; Nissim et al. (1994) *EMBO J.*, 13: 692; Griffiths et al. (1994) *EMBO J.*, 13: 3245; De Kruif et al. (1995) *J. Mol. Biol.*, 248: 97). Such diversification has been extended to include some or all of the other antigen binding loops (Crameri et al. (1996) *Nature Med.*, 2: 100; Riechmann et al. (1995) *Bio/Technology*, 13: 475; Morphosys, WO97/08320, supra).

Since loop randomization has the potential to create approximately more than $10^{15}$ structures for H3 alone and a similarly large number of variants for the other five loops, it is not feasible using current transformation technology or even by using cell free systems to produce a library representing all possible combinations. For example, in one of the largest libraries constructed to date, $6 \times 10^{10}$ different antibodies, which is only a fraction of the potential diversity for a library of this design, were generated (Griffiths et al. (1994) supra).

In one embodiment, only those residues which are directly involved in creating or modifying the desired function of the molecule are diversified. For many molecules, the function will be to bind a target and therefore diversity should be concentrated in the target binding site, while avoiding changing residues which are crucial to the overall packing of the molecule or to maintaining the chosen main-chain conformation.

6.1.1. Diversification of the Canonical Sequence as it Applies to Antibody Domains In the case of the ligands disclosed herein, the binding site for the target is most often the antigen binding site. Thus, in one aspect, libraries of or for the assembly of antibody ligands in which only those residues in the antigen binding site are varied. These residues are extremely diverse in the human antibody repertoire and are known to make contacts in high-resolution antibody/antigen complexes. For example, in L2 it is known that positions 50 and 53 are diverse in naturally occurring antibodies and are observed to make contact with the antigen. In contrast, the conventional approach would have been to diversify all the residues in the corresponding Complementarity Determining Region (CDR1) as defined by Kabat et al. (Kabat et al., 1991, *Sequences of Immunological Interest*, 5th ed. U.S. Dept. Health & Human Services, Washington, D.C.), some seven residues compared to the two diversified in the library for use as disclosed herein. This represents a significant improvement in terms of the functional diversity required to create a range of antigen binding specificities.

In nature, antibody diversity is the result of two processes: somatic recombination of germline V, D, and J gene segments to create a naive primary repertoire (so called germline and junctional diversity) and somatic hypermutation of the resulting rearranged V genes. Analysis of human antibody sequences has shown that diversity in the primary repertoire is focused at the centre of the antigen binding site whereas somatic hypermutation spreads diversity to regions at the periphery of the antigen binding site that are highly conserved in the primary repertoire (see Tomlinson et al. (1996) *J. Mol. Biol.*, 256: 813). This complementarity has probably evolved as an efficient strategy for searching sequence space and, although apparently unique to antibodies, it can easily be applied to other polypeptide repertoires. The residues which are varied are a subset of those that form the binding site for the target. Different (including overlapping) subsets of residues in the target binding site are diversified at different stages during selection, if desired.

In the case of an antibody repertoire, an initial 'naive' repertoire is created where some, but not all, of the residues in the antigen binding site are diversified. As used herein in this context, the term "naive" refers to antibody molecules that have no pre-determined target. These molecules resemble those which are encoded by the immunoglobulin genes of an individual who has not undergone immune diversification, as is the case with fetal and newborn individuals, whose immune systems have not yet been challenged by a wide variety of antigenic stimuli. This repertoire is then selected against a range of antigens or epitopes. If required, further diversity can then be introduced outside the region diversified in the initial repertoire. This matured repertoire can be selected for modified function, specificity or affinity.

Disclosed herein are two different naive repertoires of binding domains for the construction of ligands, or a naïve library of ligands, in which some or all of the residues in the antigen binding site are varied. The "primary" library mimics the natural primary repertoire, with diversity restricted to residues at the centre of the antigen binding site that are diverse in the germline V gene segments (germline diversity) or diversified during the recombination process (junctional diversity). Those residues which are diversified include, but are not limited to, H50, H52, H52a, H53, H55, H56, H58, H95, H96, H97, H98, L50, L53, L91, L92, L93, L94, and L96. In the "somatic" library, diversity is restricted to residues that are diversified during the recombination process (junctional diversity) or are highly somatically mutated). Those residues which are diversified include, but are not limited to: H31, H33, H35, H95, H96, H97, H98, L30, L31, L32, L34, and L96. All the residues listed above as suitable for diversification in these libraries are known to make contacts in one or more antibody-antigen complexes. Since in both libraries, not all of the residues in the antigen binding site are varied, additional diversity is incorporated during selection by varying the remaining residues, if it is desired to do so. It shall be apparent to one skilled in the art that any subset of any of these residues (or additional residues which comprise the antigen binding site) can be used for the initial and/or subsequent diversification of the antigen binding site.

In the construction of libraries for use as disclosed herein, diversification of chosen positions is typically achieved at the nucleic acid level, by altering the coding sequence which specifies the sequence of the polypeptide such that a number of possible amino acids (all 20 or a subset thereof) can be incorporated at that position. Using the IUPAC nomenclature, the most versatile codon is NNK, which encodes all amino acids as well as the TAG stop codon. The NNK codon is, in an aspect, used in order to introduce the required diversity. Other codons which achieve the same ends are also of use, including the NNN codon, which leads to the production of the additional stop codons TGA and TAA.

A feature of side-chain diversity in the antigen binding site of human antibodies is a pronounced bias which favours certain amino acid residues. If the amino acid composition of the ten most diverse positions in each of the $V_H$, $V_\kappa$, and $V_\lambda$ regions are summed, more than 76% of the side-chain diversity comes from only seven different residues, these being, serine (24%), tyrosine (14%), asparagine (11%), glycine (9%), alanine (7%), aspartate (6%), and threonine (6%). This bias towards hydrophilic residues and small residues which can provide main-chain flexibility probably reflects the evolution of surfaces which are predisposed to binding a wide range of antigens or epitopes and may help to explain the required promiscuity of antibodies in the primary repertoire.

Since it is preferable to mimic this distribution of amino acids, the distribution of amino acids at the positions to be varied, in an aspect, mimics that seen in the antigen binding site of antibodies. Such bias in the substitution of amino acids that permits selection of certain polypeptides (not just domain antibodies) against a range of target antigens is easily applied to any polypeptide repertoire. There are various methods for biasing the amino acid distribution at the position to be varied (including the use of tri-nucleotide mutagenesis, see WO 97/08320), of which one advantageous method, due to ease of synthesis, is the use of conventional degenerate codons. By comparing the amino acid profile encoded by all combinations of degenerate codons (with single, double, triple, and quadruple degeneracy in equal ratios at each position) with the natural amino acid use it is possible to calculate the most representative codon. The codons (AGT)(AGC)T, (AGT)(AGC)C, and (AGT)(AGC)(CT) are those closest to the desired amino acid profile: they encode 22% serine and 11% tyrosine, asparagine, glycine, alanine, aspartate, threonine, and cysteine, and in an aspect, these codons are used in the construction of a library.

6.2. Dual-Specific Ligands

Also provided herein are dual-specific ligands comprising domain antibodies which each have respective specificities; that is, the first and the second epitopes bound by the dual-specific ligand are, in an aspect, different or are two copies of the same epitopes, the epitopes being bound by a respective variable domain. In an embodiment, a "dual-specific ligand" refers to a ligand comprising a first domain antibody and a second domain antibody as herein defined, wherein the variable regions are capable of binding to two different antigens or two epitopes on the same antigen which are not normally bound by a monospecific immunoglobulin. In another embodiment, a "dual-specific ligand" refers to a ligand comprising a domain antibody and an immunoglobulin variable domain as herein defined, wherein the variable regions are capable of binding to two different antigens or two epitopes on the same antigen which are not normally bound by a monospecific immunoglobulin. For example, the two epitopes may be on the same hapten, but are not the same epitope or sufficiently adjacent to be bound by a monospecific ligand. The dual specific ligands disclosed herein are composed of variable domains which have different specificities, and do not contain mutually complementary variable domain pairs which have the same specificity. Dual-specific ligands may be, or be part of, polypeptides, proteins, or nucleic acids, which may be naturally occurring or synthetic.

Advantageously, the dual- or multispecific ligand may comprise a first domain capable of binding a target molecule, and a second domain capable of binding a molecule or group which extends the half-life of the ligand. For example, the molecule or group may be a bulky agent, such as HSA or a cell matrix protein. As used herein, the phrase "molecule or group which extends the half-life of a ligand" refers to a molecule or chemical group which, when bound by a dual-specific ligand as described herein increases the in vivo half-life of such dual specific ligand when administered to an animal, relative to a ligand that does not bind that molecule or group. Examples of molecules or groups that extend the half-life of a ligand are described herein below. In one embodiment, the closed conformation multispecific ligand may be capable of binding the target molecule only on displacement of the half-life enhancing molecule or group. Thus, for example, a closed conformation multispecific ligand is maintained in circulation in the bloodstream of a subject by a bulky molecule such as HSA. When a target molecule is encountered, competition between the binding domains of the closed conformation multispecific ligand results in displacement of the HSA and binding of the target. Molecules which increase half-life are discussed in further detail above.

In one embodiment of the second configuration disclosed herein, the variable domains are derived from an antibody directed against the first and/or second antigen or epitope. In one embodiment the variable domains are derived from a repertoire of single variable antibody domains. In one example, the repertoire is a repertoire that is not created in an animal or a synthetic repertoire. In another example, the single variable domains are not isolated (at least in part) by animal immunization. Thus, the single domains can be isolated from a naïve library.

In another aspect, disclosed herein is a multi-specific ligand comprising a first epitope binding domain having a first epitope binding specificity and a non-complementary second epitope binding domain having a second epitope binding specificity. The first and second binding specificities may be the same or different.

In a further aspect, disclosed herein is a closed conformation multi-specific ligand comprising a first epitope binding domain having a first epitope binding specificity and a non-complementary second epitope binding domain having a second epitope binding specificity wherein the first and second binding specificities are capable of competing for epitope binding such that the closed conformation multi-specific ligand cannot bind both epitopes simultaneously.

Ligands according to any aspect as disclosed herein, as well as domain antibody monomers useful in constructing such ligands, may advantageously dissociate from their cognate target(s) with a $K_d$ of about 300 nM to 1 pM or 5 pM (ie, $3 \times 10^{-7}$ to $5 \times 10^{-12}$ M), in an aspect, about 50 nM to 20 pM, or 5 nM to 200 pM or 1 nM to 100 pM, $1 \times 10^{-7}$ M or less, $1 \times 10^{-8}$ M or less, $1 \times 10^{-9}$ M or less, $1 \times 10^{-10}$ M or less, $1 \times 10^{-11}$ M or less; and/or a $K_{off}$ rate constant of about $5 \times 10^{-1}$ to $1 \times 10^{-7}$ $S^{-1}$, in an aspect, about $1 \times 10^{-2}$ to $1 \times 10^{-6}$ $S^{-1}$, or $5 \times 10^{-3}$ to $1 \times 10^{-5}$ $S^{-1}$, or $5 \times 10^{-1}$ $S^{-1}$ or less, or $1 \times 10^{-2}$ $S^{-1}$ or less, or $1 \times 10^{-3}$ $S^{-1}$ or less, or $1 \times 10^{-4}$ $S^{-1}$ or less, or $1 \times 10^{-5}$ $S^{-1}$ or less, or $1 \times 10^{-6}$ $S^{-1}$ or less as determined by surface plasmon resonance. The $K_d$ rate constant is defined as $K_{off}/K_{on}$. Additional details regarding dual specific ligands can be found in WO 03/002609, WO 04/003019 and WO 04/058821.

Furthermore, a domain antibody monomer is provided (or dual specific ligand comprising such a domain antibody) that binds to serum albumin (SA) with a $K_d$ of 1 nM to 500 μM (i.e., $1 \times 10^{-9}$ M to $5 \times 10^{-4}$ M), in an aspect, 100 nM to 10 μM. In an aspect, for a dual specific ligand comprising a first anti-SA domain antibody and a second domain antibody to another target, the affinity (e.g. $K_d$ and/or $K_{off}$ as measured by surface plasmon resonance, e.g. using BiaCore) of the second dAb for its target is from 1 to 100,000 times (in an aspect, 100 to 100,000, in a further aspect, 1000 to 100000, or 10000 to 100000 times) the affinity of the first domain antibody for SA. For example, the first domain antibody binds SA with an affinity of approximately 10 μM, while the second domain antibody binds its target with an affinity of about 100 pM. In an exemplary embodiment, the serum albumin is human serum albumin (HSA).

In one embodiment, the first domain antibody (or a domain antibody monomer) binds SA (eg, HSA) with a $K_d$ of approximately about 50 nM, in an aspect, about 70 nM, and in another aspect, about 100, 150, or 200 nM.

Also provided are dimers, trimers and polymers of the aforementioned domain antibody monomers, in accordance with the foregoing aspect.

Ligands disclosed herein, including domain antibody monomers, dimers and trimers, can be linked to an antibody Fc region, comprising one or both of $C_H2$ and $C_H3$ domains, and optionally a hinge region. For example, vectors encoding ligands linked as a single nucleotide sequence to an Fc region may be used to prepare such polypeptides. Alternatively, ligands disclosed herein may be free of an Fc domain.

In a further aspect is provided one or more nucleic acid molecules encoding at least a dual- or multispecific ligand as herein defined. In one embodiment, the ligand is a closed conformation ligand. In another embodiment, it is an open conformation ligand. The multispecific ligand may be encoded on a single nucleic acid molecule; alternatively, each epitope binding domain may be encoded by a separate nucleic acid molecule. Where the ligand is encoded by a single nucleic acid molecule, the domains may be expressed as a fusion polypeptide, or may be separately expressed and subsequently linked together, for example using chemical linking agents. Ligands expressed from separate nucleic acids will be linked together by appropriate means.

The nucleic acid may further encode a signal sequence for export of the polypeptides from a host cell upon expression and may be fused with a surface component of a filamentous bacteriophage particle (or other component of a selection display system) upon expression. Leader sequences, which may be used in bacterial expression and/or phage or phagemid display, include pelB, stII, ompA, phoA, bla, ompT and pelA.

In a further aspect of the second configuration as disclosed herein includes a vector comprising nucleic acid.

In a yet further aspect is provided a host cell transfected with a vector.

Expression from such a vector may be configured to produce, for example on the surface of a bacteriophage particle, epitope binding domains for selection. This allows selection of displayed domains and thus selection of "multispecific ligands" using the method as disclosed herein.

6.2.1. Structure of 'Dual-Specific Ligands'

As described above, an antibody is herein defined as an antibody or fragment (Fab, Fv, disulfide linked Fv, scFv, diabody) which comprises at least one heavy and a light chain variable domain, at least two heavy chain variable domains or at least two light chain variable domains. It may be at least partly derived from any species naturally producing an antibody, or created by recombinant DNA technology; whether isolated from serum, B-cells, hybridomas, transfectomas, yeast or bacteria).

In one embodiment, the dual-specific ligand comprises at least one single heavy chain variable domain of an antibody and one single light chain variable domain of an antibody, or two single heavy or light chain variable domains. For example, the ligand may comprise a $V_H/V_L$ pair, a pair of $V_H$ domains or a pair of $V_L$ domains.

The first and the second variable domains of such a ligand may be on the same polypeptide chain. Alternatively they may be on separate polypeptide chains. In the case that they are on the same polypeptide chain they may be linked by a linker, which may be a peptide sequence, as described above.

The first and second variable domains may be covalently or non-covalently associated. In the case that they are covalently associated, the covalent bonds may be disulphide bonds.

In the case that the variable domains are selected from V-gene repertoires selected for instance using phage display technology as herein described, then these variable domains comprise a universal framework region, such that is they may be recognized by a specific generic ligand as herein defined. The use of universal frameworks, generic ligands, and the like is described in WO 99/20749.

Where V-gene repertoires are used variation in polypeptide sequence is, in an aspect, located within the structural loops of the variable domains. The polypeptide sequences of either variable domain may be altered by DNA shuffling or by mutation in order to enhance the interaction of each variable domain with its complementary pair. DNA shuffling is known in the art and taught, for example, by Stemmer (1994) Nature 370: 389-391 and U.S. Pat. No. 6,297,053, both of which are incorporated herein by reference. Other methods of mutagenesis are well known to those of skill in the art.

In one embodiment, the 'dual-specific ligand' is a single chain Fv fragment. In an alternative embodiment, the 'dual-specific ligand' consists of a Fab format.

A further aspect disclosed herein provides nucleic acid encoding at least a 'dual-specific ligand' as herein defined.

One skilled in the art will appreciate that, depending on the aspect, both antigens or epitopes may bind simultaneously to the same antibody molecule. Alternatively, they may compete for binding to the same antibody molecule. For example, where both epitopes are bound simultaneously, both variable domains of a dual specific ligand are able to independently bind their target epitopes. Where the domains compete, the one variable domain is capable of binding its target, but not at the same time as the other variable domain binds its cognate target; or the first variable domain is capable of binding its target, but not at the same time as the second variable domain binds its cognate target.

The variable regions may be derived from antibodies directed against target antigens or epitopes. Alternatively they may be derived from a repertoire of single antibody domains such as those expressed on the surface of filamentous bacteriophage. Selection may be performed as described below.

In general, the nucleic acid molecules and vector constructs required for the performance as disclosed herein may be constructed and manipulated as set forth in standard laboratory manuals, such as Sambrook et al. (1989) *Molecular Cloning: A Laboratory Manual*, Cold Spring Harbor, USA.

The manipulation of nucleic acids useful as disclosed herein is typically carried out in recombinant vectors.

Thus, a further aspect disclosed herein provides a vector comprising nucleic acid encoding at least a 'dual-specific ligand' as herein defined.

As used herein, vector refers to a discrete element that is used to introduce heterologous DNA into cells for the expression and/or replication thereof. Methods by which to select or construct and, subsequently, use such vectors are well known to one of ordinary skill in the art. Numerous vectors are publicly available, including bacterial plasmids, bacteriophage, artificial chromosomes, and episomal vectors. Such vectors may be used for simple cloning and mutagenesis; alternatively gene expression vector is employed. A vector of use as disclosed herein may be selected to accommodate a polypeptide coding sequence of a desired size, typically from 0.25 kilobase (kb) to 40 kb or more in length. A suitable host cell is transformed with the vector after in vitro cloning manipulations. Each vector contains various functional components, which generally include a cloning (or "polylinker") site, an origin of replication, and at least one selectable marker gene. If given vector is an expression vector, it additionally possesses one or more of the following: enhancer element, promoter, transcription termination, and signal sequences, each positioned in the vicinity of the cloning site, such that they are operatively linked to the gene encoding a ligand as disclosed herein.

Both cloning and expression vectors generally contain nucleic acid sequences that enable the vector to replicate in one or more selected host cells. Typically in cloning vectors, this sequence is one that enables the vector to replicate independently of the host chromosomal DNA and includes origins of replication or autonomously replicating sequences. Such sequences are well known for a variety of bacteria, yeast, and viruses. The origin of replication from the plasmid pBR322 is suitable for most Gram-negative bacteria, the 2 micron plasmid origin is suitable for yeast, and various viral origins (e.g. SV 40, adenovirus) are useful for cloning vectors in mammalian cells. Generally, the origin of replication is not needed for mammalian expression vectors unless these are used in mammalian cells able to replicate high levels of DNA, such as COS cells.

Advantageously, a cloning or expression vector may contain a selection gene also referred to as selectable marker. This gene encodes a protein necessary for the survival or growth of transformed host cells grown in a selective culture medium. Host cells not transformed with the vector containing the selection gene will therefore not survive in the culture medium. Typical selection genes encode proteins that confer resistance to antibiotics and other toxins, e.g. ampicillin, neomycin, methotrexate or tetracycline, complement auxotrophic deficiencies, or supply critical nutrients not available in the growth media.

6.2.2. Combining Single Variable Domains

Domains useful as disclosed herein, once selected using methods exemplified above, may be combined by a variety of methods known in the art, including covalent and non-covalent methods.

Methods include the use of polypeptide linkers, as described, for example, in connection with scFv molecules (Bird et al., (1988) *Science* 242: 423-426). Discussion of suitable linkers is provided in Bird et al., *Science* 242: 423-426; Hudson et al., (1999) *J. Immunol. Methods* 231: 177-189; Hudson et al., *Proc. Nat'l Acad. Sci. USA* 85: 5879-5883. Linkers are in an aspect, flexible, allowing the two single domains to interact. One linker example is a $(Gly_4\ Ser)_n$ linker, where n=1 to 8, e.g., 2, 3, 4, 5, or 7. The linkers used in diabodies, which are less flexible, may also be employed (Holliger et al., (1993) *PNAS* (USA) 90: 6444-6448).

In one embodiment, the linker employed is not an immunoglobulin hinge region.

Variable domains may be combined using methods other than linkers. For example, the use of disulphide bridges, provided through naturally-occurring or engineered cysteine residues, may be exploited to stabilize $V_H$-$V_H$, $V_L$-$V_L$ or $V_H$-$V_L$ dimers (Reiter et al., (1994) *Protein Eng.* 7: 697-704) or by remodeling the interface between the variable domains to improve the "fit" and thus the stability of interaction (Ridgeway et al., (1996) *Protein Eng.* 7: 617-621; Zhu et al., (1997) *Protein Science* 6: 781-788).

Other techniques for joining or stabilizing variable domains of immunoglobulins, and in particular antibody $V_H$ domains, may be employed as appropriate.

As disclosed herein, dual specific ligands can be in "closed" conformations in solution. A "closed" configuration is that in which the two domains (for example $V_H$ and $V_L$) are present in associated form, such as that of an associated $V_H$-$V_L$ pair which forms an antibody binding site. For example, scFv may be in a closed conformation, depending on the arrangement of the linker used to link the $V_H$ and $V_L$ domains. If this is sufficiently flexible to allow the domains to associate, or rigidly holds them in the associated position, it is likely that the domains will adopt a closed conformation.

Similarly, $V_H$ domain pairs and $V_L$ domain pairs may exist in a closed conformation. Generally, this will be a function of close association of the domains, such as by a rigid linker, in the ligand molecule. Ligands in a closed conformation will be unable to bind both the molecule which increases the half-life of the ligand and a second target molecule. Thus, the ligand will typically only bind the second target molecule on dissociation from the molecule which increases the half-life of the ligand.

Moreover, the construction of $V_H/V_H$, $V_L/V_L$ or $V_H/V_L$ dimers without linkers provides for competition between the domains.

Ligands as disclosed herein may moreover be in an open conformation. In such a conformation, the ligands will be able to simultaneously bind both the molecule which increases the half-life of the ligand and the second target molecule. Typically, variable domains in an open configuration are (in the case of $V_H$-$V_L$ pairs) held far enough apart for the domains not to interact and form an antibody binding site and not to compete for binding to their respective epitopes. In the case of $V_H/V_H$ or $V_L/V_L$ dimers, the domains are not forced together by rigid linkers. Naturally, such domain pairings will not compete for antigen binding or form an antibody binding site.

Fab fragments and whole antibodies will exist primarily in the closed conformation, although it will be appreciated that open and closed dual specific ligands are likely to exist in a variety of equilibria under different circumstances. Binding of the ligand to a target is likely to shift the balance of the equilibrium towards the open configuration. Thus, certain ligands disclosed herein can exist in two conformations in solution, one of which (the open form) can bind two antigens or epitopes independently, whilst the alternative conformation (the closed form) can only bind one antigen or epitope; antigens or epitopes thus compete for binding to the ligand in this conformation.

Although the open form of the dual specific ligand may thus exist in equilibrium with the closed form in solution, it is envisaged that the equilibrium will favor the closed form; moreover, the open form can be sequestered by target binding into a closed conformation. In an exemplary embodiment, therefore, certain dual specific ligands disclosed herein are present in an equilibrium between two (open and closed) conformations.

Dual specific ligands disclosed herein may be modified in order to favor an open or closed conformation. For example, stabilization of $V_H$-$V_L$ interactions with disulphide bonds stabilizes the closed conformation. Moreover, linkers used to join the domains, including $V_H$ domain and $V_L$ domain pairs, may be constructed such that the open from is favored; for example, the linkers may sterically hinder the association of the domains, such as by incorporation of large amino acid residues in opportune locations, or the designing of a suitable rigid structure which will keep the domains physically spaced apart.

6.2.3. Characterization of the Dual-Specific Ligand.

The binding of the dual-specific ligand to its specific antigens or epitopes can be tested by methods which will be familiar to those skilled in the art and include ELISA. In one embodiment, binding is tested using monoclonal phage ELISA.

Phage ELISA may be performed according to any suitable procedure: an exemplary protocol is set forth below.

Populations of phage produced at each round of selection can be screened for binding by ELISA to the selected antigen or epitope, to identify "polyclonal" phage antibodies. Phage from single infected bacterial colonies from these populations can then be screened by ELISA to identify "monoclonal" phage antibodies. It is also desirable to screen soluble antibody fragments for binding to antigen or epitope, and this can also be undertaken by ELISA using reagents, for example, against a C- or N-terminal tag (see for example Winter et al. (1994) *Ann. Rev. Immunology* 12, 433-55 and references cited therein.

The diversity of the selected phage monoclonal antibodies may also be assessed by gel electrophoresis of PCR products (Marks et al. (1991) supra; Nissim et al. (1994) supra), probing (Tomlinson et al., (1992) *J. Mol. Biol.* 227, 776) or by sequencing of the vector DNA.

7. Increasing Polypeptide Stability 7.1. Increasing Half-Life

In vivo, the PEGylated domain antibodies as described herein may confer a distinct advantage over non-PEGylated domain antibodies, in that the PEGylated antibody molecules will have a greatly prolonged in vivo half-life. It will be understood, in the context of the present disclosure, that a particular half-life of any composition may be either increased or decreased by the route of administration of the composition to a patient.

Nonetheless, without being bound to one particular theory, it is believed that the increased half-life of the molecules described herein is conferred by the increased hydrodynamic size of the domain antibody resulting from the attachment of PEG polymer(s). More specifically, it is believed that two parameters play an important role in determining the serum half-life of PEGylated domain antibodies. The first criterion is the nature and size of the PEG attachment, i.e., if the polymer used is simply a linear chain or a branched/forked chain, wherein the branched/forked chain gives rise to a longer half-life. The second is the location of the PEG moiety or moieties on the domain antibody in the final format and how many "free" unmodified PEG arms the molecule has. The resulting hydrodynamic size of the PEGylated domain antibody, as estimated, for example, by size exclusion chromatography, reflects the serum half-life of the molecule. Accordingly, the larger the hydrodynamic size of the PEGylated molecule, the greater the serum half-life.

Increased half-life is useful in vivo applications of immunoglobulins, especially antibodies and most especially antibody fragments of small size, as well as domain antibodies. Such fragments (Fvs, Fabs, scFvs) and domain antibodies suffer from rapid clearance from the body; thus, while they are able to reach most parts of the body rapidly, and are quick to produce and easier to handle, their in vivo applications have been limited by their only brief persistence in vivo.

In one aspect, a domain antibody as described herein is stabilized in vivo by fusion with a moiety, such as PEG, that increases the hydrodynamic size of the domain antibody. Methods for pharmacokinetic analysis and determination of half-life will be familiar to those skilled in the art. Details may be found in Kenneth et al., *Chemical Stability of Pharmaceuticals: A Handbook for Pharmacists* and in Peters et al., *Pharmacokinetic Analysis: A Practical Approach* (1996). Reference is also made to "Pharmacokinetics", M. Gibaldi & D. Perron, published by Marcel Dekker, $2^{nd}$ Rev. edition (1982), which describes pharmacokinetic parameters such as t-α and t-β half lives and area under the curve (AUC).

Typically, the half-life of a PEGylated domain antibody as described herein is increased by about 10%, 20%, 30%, 40%, 50%, or more relative to a non-PEGylated dAb (wherein the domain antibody of the PEGylated domain antibody and non-PEGylated domain antibody are the same). Increases in the range of 2×, 3×, 4×, 5×, 7×, 10×, 20×, 30×, 40×, and up to 50× or more of the half-life are possible. Alternatively, or in addition, increases in the range of up to 30×, 40×, 50×, 60×, 70×, 80×, 90×, 100×, or 150× of the half-life are possible.

Half lives (t½-α and t½-β) and AUC can be determined from a curve of serum concentration of ligand against time. The WinNonlin analysis package (available from Pharsight Corp., Mountain View, Calif. 94040, USA) can be used, for example, to model the curve. In a first phase (the alpha phase) the ligand is undergoing mainly distribution in the patient, with some elimination. A second phase (beta phase) is the terminal phase when the ligand has been distributed and the serum concentration is decreasing as the ligand is cleared from the patient. The "tα half-life" is the half-life of the first phase and the "tβ half-life" is the half-life of the second phase. "Half-life" as used herein, unless otherwise noted, refers to the overall half-life of an antibody single variable domain disclosed herein determined by non-compartment modeling (as contrasted with biphasic modeling, for example). Beta half-life is a measurement of the time it takes for the amount of domain antibody monomer or multimer to be cleared from the mammal to which it is administered. Thus, advantageously, a domain antibody-containing composition, e.g., a domain antibody-effector group composition is contemplated having a tα half-life in the range of about 0.25 hours to 6 hours or more. In one embodiment, the lower end of the range is about 30 minutes, 45 minutes, 1 hour, 1.3 hours, 2 hours, 3 hours, 4 hours, 5 hours, 6 hours, 7 hours, 10 hours, 11 hours, or 12 hours. In addition or alternatively, a domain antibody-containing composition will have a tα half-life in the range of up to and including 12 hours. In one embodiment, the upper end of the range is about 11, 10, 9, 8, 7, 6, or 5 hours. An example of a suitable range is about 1.3 to 6 hours, 2 to 5 hours, or 3 to 4 hours.

Advantageously, a domain antibody-containing composition comprising a ligand has a tβ half-life in the range of about 1-170 hours or more. In one embodiment, the lower end of the range is about 2.5 hours, 3 hours, 4 hours, 5 hours, 6 hours, 7 hours, 8 hours, 9 hours, 10 hours, 11 hours, or 12 hours. In addition, or alternatively, a domain antibody-containing composition, e.g. a dAb-effector group composition has a tβ half-life in the range of up to and including 21 days. In one embodiment, the upper end of the range is about 12 hours, 24 hours, 2 days, 3 days, 5 days, 10 days, 15 days, or 20 days. Advantageously, a dAb containing composition disclosed herein will have a tβ half-life in the range about 2-100 hours, 4-80 hours, and 10-40 hours. In a further embodiment, it will be in the range of about 12-48 hours. In a further embodiment still, it will be in the range of about 12-26 hours. Disclosed herein is a domain antibody-containing composition comprising a ligand having a half-life in the range of 1-170 hours or more. In one embodiment, the lower end of the range is about 1.3 hours, 2.5 hours, 3 hours, 4 hours, 5 hours, 6 hours, 7 hours, 8 hours, 9 hours, 10 hours, 11 hours, or 12 hours. In addition, or alternatively, a domain antibody-containing composition, e.g. a dAb-effector group composition, has a half-life in the range of up to and including 21 days. In one embodiment, the upper end of the range is about 12 hours, 24 hours, 2 days, 3 days, 5 days, 10 days, 15 days, or 20 days.

In addition, or alternatively to the above criteria, a domain antibody-containing composition comprising a ligand has an AUC value (area under the curve) in the range of 1 mg·min/ml or more. In one embodiment, the lower end of the range is about 5, 10, 15, 20, 30, 100, 200, or 300 mg·min/ml. In addition, or alternatively, a ligand or composition disclosed herein has an AUC in the range of up to about 600 mg·min/ml. In one embodiment, the upper end of the range is about 500, 400, 300, 200, 150, 100, 75, or 50 mg·min/ml. Exemplary ligands disclosed herein will have an AUC in the range selected from the group consisting of the following: about 15 to 150 mg·min/ml, 15 to 100 mg·min/ml, 15 to 75 mg·min/ml, and 15 to 50 mg·min/ml.

The ligands disclosed herein, including, mono-, dual- and multi-specific, in one configuration thereof, are capable of binding to one or more molecules which can increase the half-life of the ligand in vivo. Typically, such molecules are polypeptides which occur naturally in vivo and which resist degradation or removal by endogenous mechanisms which remove unwanted material from the organism.

For example, the molecule which increases the half-life in the organism may be selected from the following:

Proteins from the extracellular matrix; for example collagen, laminins, integrins, and fibronectin. Collagens are the major proteins of the extracellular matrix. About 15 types of collagen molecules are currently known, found in different parts of the body, e.g. type I collagen (accounting for 90% of body collagen) found in bone, skin, tendon, ligaments, cornea, internal organs, or type II collagen found in cartilage, invertebral disc, notochord, vitreous humour of the eye.

Proteins found in blood, including: Plasma proteins such as fibrin, α-2 macroglobulin, serum albumin, fibrinogen A, fibrinogen B, serum amyloid protein A, heptaglobin, profilin, ubiquitin, uteroglobulin, and β2-microglobulin;

Enzymes and inhibitors such as plasminogen, lysozyme, cystatin C, alpha-1-antitrypsin, and pancreatic trypsin inhibitor. Plasminogen is the inactive precursor of the trypsin-like serine protease plasmin. It is normally found circulating through the blood stream. When plasminogen becomes activated and is converted to plasmin, it unfolds a potent enzymatic domain that dissolves the fibrinogen fibers that entangle the blood cells in a blood clot. This is called fibrinolysis.

Immune system proteins, such as IgE, IgG, and IgM.

Transport proteins such as retinol binding protein, α-1 microglobulin.

Defensins such as beta-defensin 1, neutrophil defensins 1, 2, and 3.

Proteins found at the blood brain barrier or in neural tissues, such as melanocortin receptor, myelin, ascorbate transporter.

Transferrin receptor specific ligand-neuropharmaceutical agent fusion proteins (see U.S. Pat. No. 5,977,307); brain capillary endothelial cell receptor, transferrin, transferrin receptor, insulin, insulin-like growth factor 1 (IGF 1) receptor, insulin-like growth factor 2 (IGF 2) receptor, insulin receptor.

Proteins localised to the kidney, such as polycystin, type IV collagen, organic anion transporter K1, Heymann's antigen.

Proteins localised to the liver, for example alcohol dehydrogenase, G250.

Blood coagulation factor X

α1 antitrypsin

HNF 1α

Proteins localised to the lung, such as secretory component (binds IgA).

Proteins localised to the heart, for example HSP 27. This is associated with dilated cardiomyopathy.

Proteins localised to the skin, for example keratin.

Bone specific proteins, such as bone morphogenic proteins (BMPs), which are a subset of the transforming growth factor β superfamily that demonstrate osteogenic activity. Examples include BMP-2, -4, -5, -6, -7 (also referred to as osteogenic protein (OP-1) and -8 (OP-2).

Tumour specific proteins, including human trophoblast antigen, herceptin receptor, oestrogen receptor, cathepsins (e.g. cathepsin B) (found in liver and spleen).

Disease-specific proteins, such as antigens expressed only on activated T cells: including LAG-3 (lymphocyte activation gene), osteoprotegerin ligand (OPGL) (see *Nature* 402, 304-309; 1999); OX40 (a member of the TNF receptor family, expressed on activated T cells and the only co-stimulatory T cell molecule known to be specifically up-regulated in human T cell leukemia virus type-I (HTLV-I)-producing cells.) (see *J. Immunol.* 165 (1): 263-70, 2000); metalloproteases (associated with arthritis/cancers), including CG6512 *Drosophila*, human paraplegin, human FtsH, human AFG3L2, murine ftsH; angiogenic growth factors, including acidic fibroblast growth factor (FGF-1), basic fibroblast growth factor (FGF-2), vascular endothelial growth factor/vascular permeability factor (VEGF/VPF), transforming growth factor-a (TGF a), tumor necrosis factor-alpha (TNF-α), angiogenin, interleukin-3 (IL-3), interleukin-8 (IL-8), platelet-derived endothelial growth factor (PD-ECGF), placental growth factor (PlGF), midkine platelet-derived growth factor-BB (PDGF), fractalkine.

Stress proteins (heat shock proteins). HSPs are normally found intracellularly. When they are found extracellularly, it is an indicator that a cell has died and spilled out its contents. This unprogrammed cell death (necrosis) only occurs when as a result of trauma, disease, or injury, and therefore in vivo, extracellular HSPs trigger a response from the immune system that will fight infection and disease. A dual specific which binds to extracellular HSP can be localized to a disease site.

Proteins involved in Fc transport, such as:

The Brambell receptor (also known as FcRB). This Fc receptor has two functions, both of which are potentially useful for delivery. The functions include the transport of IgG from mother to child across the placenta and the protection of IgG from degradation thereby prolonging its serum half-life of IgG. It is thought that the receptor recycles IgG from endosome (see Holliger et al, (1997) *Nat. Biotechnol.* 15: 632-6).

Other proteins involved in Fc transport include the neonatal Fc receptor (FcRn) described in Gastinel et al. (1992) *PNAS* 89: 638; and Roopenian et al. (2003) *J. Immunol.* 170: 3528.

Ligands disclosed herein may be designed to be specific for the above targets without requiring any increase in or increasing half-life in vivo. For example, ligands disclosed herein can be specific for targets selected from the foregoing which are tissue-specific, thereby enabling tissue-specific targeting of the dual specific ligand, or a domain antibody that binds a tissue-specific therapeutically relevant target, irrespective of any increase in half-life, although this may result. Moreover, where the ligand or domain antibody targets kidney or liver, this may redirect the ligand or domain antibody to an alternative clearance pathway in vivo (for example, the ligand may be directed away from liver clearance to kidney clearance).

Polypeptides useful for increasing half-life include, but are not limited to those shown in Annex I.

7.2. Increasing Resistance to Protease Degradation

Also disclosed herein is that the PEGylated domain antibodies and domain antibody multimers described herein possess increased stability to the action of proteases. In the presence of pepsin many domain antibodies are totally degraded at pH 2 because the protein is unfolded under the acid conditions, thus making the protein more accessible to the protease enzyme. Provided herein are PEGylated domain antibody molecules, including domain antibody multimers, wherein it is believed that the PEG polymer provides protection of the polypeptide backbone due the physical coverage of the backbone by the PEG polymer, thereby preventing the protease from gaining access to the polypeptide backbone and cleaving it. In one embodiment a PEGylated domain antibody having a higher hydrodynamic size (e.g., 200 to 500 kD) is generated as disclosed herein, because the larger hydrodynamic size will confirm a greater level of protection from protease degradation than a PEGylated domain antibody having a lower hydrodynamic size. In one embodiment, a PEG- or other polymer-linked antibody single variable domain monomer or multimer is degraded by no more than 10% when exposed to one or more of pepsin, trypsin, elastase, chymotrypsin, or carboxypeptidase, wherein if the protease is pepsin then exposure is carried out at pH 2.0 for 30 minutes, and if the protease is one or more of trypsin, elastase, chymotrypsin, or carboxypeptidase, then exposure is carried out at pH 8.0 for 30 minutes. In one embodiment, a PEG- or other polymer-linked domain antibody monomer or multimer is degraded by no more than 10% when exposed to pepsin at pH 2.0 for 30 minutes, in an aspect, no more than 5%, and in another aspect, not degraded at all. In another embodiment, a PEG- or other polymer-linked domain antibody multimer (e.g., hetero- or homodimer, trimer, tetramer, octamer, etc.) disclosed herein is degraded by less than 5%, and is, in an aspect, not degraded at all in the presence of pepsin at pH 2.0 for 30 minutes. In an exemplary embodiment, a PEG- or other polymer-linked domain antibody monomer or multimer is degraded by no more than 10% when exposed to trypsin, elastase, chymotrypsin, or carboxypeptidase at pH 8.0 for 30 minutes, in an aspect, no more than 5%, and in a further aspect, not degraded at all. In a further exemplary embodiment, a PEG- or other polymer-linked domain antibody multimer (e.g., hetero- or homodimer, trimer, tetramer, octamer, etc.) disclosed herein is degraded by less than 5%, and is, in an aspect, not degraded at all in the presence of trypsin, elastase, chymotrypsin, or carboxypeptidase at pH 8.0 for 30 minutes.

The relative ratios of protease:PEG-domain antibody may be altered as disclosed herein to achieve the desired level of degradation as described above. For example the ratio of protease to PEG-domain antibody may be from about 1:30, to about 10:40, to about 20:50, to about 30:50, about 40:50, about 50:50, about 50:40, about 50:30, about 50:20, about 50:10, about 50:1, about 40:1, and about 30:1.

Accordingly, disclosed herein is a method for decreasing the degradation of domain antibody comprising linking a domain antibody monomer or multimer to a PEG polymer according to any of the embodiments described herein. As disclosed herein, the domain antibody is degraded by no more than 10% in the presence of pepsin at pH 2.0 for 30 minutes. In particular, a PEG-linked dAb multimer is degraded by no more than 5%, and in an aspect, not degraded at all in the presence of pepsin at pH 2.0 for 30 minutes. In an alternate embodiment, the domain antibody is degraded by no more than 10% when exposed to trypsin, elastase, chymotrypsin, or carboxypeptidase at pH 8.0 for 30 minutes, in an aspect, no more than 5%, and in another aspect, not degraded at all.

Degradation of PEG-linked domain antibody monomers and multimers as set forth herein may be measured using methods which are well known to those of skill in the art. For example, following incubation of a PEG-linked domain antibody with pepsin at pH 2.0 for 30 minutes, or with trypsin, elastase, chymotrypsin, or carboxypeptidase at pH 8.0 for 30 minutes, the domain antibody samples may be analyzed by gel filtration, wherein degradation of the domain antibody monomer or multimer is evidenced by a gel band of a smaller molecular weight than an un-degraded (i.e., control domain antibody not treated with pepsin, trypsin, chymotrypsin, elastase, or carboxypeptidase) domain antibody. Molecular weight of the domain antibody bands on the gel may be determined by comparing the migration of the band with the migration of a molecular weight ladder (see FIG. 5). Other methods of measuring protein degradation are known in the art and may be adapted to evaluate the PEG-linked domain antibody monomers and multimers as disclosed herein.

8. Uses of Domain Antibodies

Domain antibodies as described herein are useful for antagonizing the activity of CD28. Therefore, domain antibodies as described herein can be used to treat a patient having a condition, disease or disorder mediated in whole or in part by CD28 activity.

Domain antibodies as described herein are useful for the treatment or prevention of diseases or disorders in which inappropriate activation of a CD28-mediated pathway is involved. Domain antibodies as described herein are also useful for the treatment, prevention, or alleviation of symptoms of diseases or disorders in which inappropriate activation of a CD28-mediated pathway is involved.

In an aspect, autoimmune diseases frequently involve inappropriate regulation or activity of CD28 pathways. Administration of a domain antibody as described herein to an individual suffering from such a disease, including an autoimmune disease, can reduce one or more symptoms of the disease. Non-limiting examples of diseases for which the domain antibodies described herein can be therapeutically useful include, but are not limited to, Addison's disease, allergy, ankylosing spondylitis, asthma, atherosclerosis, autoimmune diseases of the ear, autoimmune diseases of the eye, autoimmune atrophic gastritis, autoimmune hepatitis, autoimmune hymolytic anemia, autoimmune parotitis, primary biliary cirrhosis, benign lymphocytic aniitis, colitis, coronary heart disease, Crohn's disease, diabetes (Type I), diabetes, including Type 1 and/or Type 2 diabetes, epididymitis, glomerulonephritis, Goodpasture's syndrome, Graves' disease, Guillain-Barre syndrome, Hashimoto's disease, hemolytic anemia, idiopathic thrombocytopenic purpura, inflammatory bowel disease (IBD), immune response to recombinant drug products, e.g., factor VII in hemophilia, systemic lupus erythematosus, lupus nephritis, male infertility, mixed connective tissue disease, multiple sclerosis, myasthenia gravis, primary myxedema, pemphigus, pernicious anemia, polymyositis, psoriasis, psoriatic arthritis, rheumatic fever, rheumatoid arthritis, sarcoidosis, scleroderma, Sjogren's syndrome, spondyloarthropathies, sympathetic ophthalmia, T-cell lymphoma, T-cell acute lymphoblastic leukemia, testicular antiocentric T-cell lymphoma, thyroiditis, transplant rejection, ulcerative colitis, autoimmune uveitis, and vasculitis. Autoimmune-mediated conditions include, but are not limited to, conditions in which the tissue affected is the primary target, and in some cases, the secondary target. Such conditions include, but are not limited to, AIDS, atopic allergy, bronchial asthma, eczema, leprosy, schizophrenia, inherited depression, transplantation of tissues and organs, chronic fatigue syndrome, Alzheimer's disease, Parkinson's disease, myocardial infarction, stroke, autism, epilepsy, Arthus's phenomenon, anaphylaxis, and alcohol and drug addiction.

The domain antibodies described herein also can be therapeutically useful in graft-related diseases, such as graft versus host disease (GVHD), acute transplantation rejection, and chronic transplantation rejection.

The domain antibodies described herein are additionally useful in the way that generally any antibody preparation is useful, e.g., for in vivo imaging or diagnostic uses, in vitro diagnostic uses, etc.

For these and other uses it may be desirable to label the domain antibodies, e.g., with a fluorescent, calorimetric, enzymatic or radioactive label. Methods of labeling domain antibodies are well known in the art.

9. Pharmaceutical Compositions, Dosage, and Administration

The domain antibodies set forth herein can be incorporated into pharmaceutical compositions suitable for administration to a subject. Typically, the pharmaceutical composition comprises a domain antibody and a pharmaceutically acceptable carrier. As used herein, "pharmaceutically acceptable carrier" includes any and all solvents, dispersion media, coatings, antibacterial, and antifungal agents, isotonic and absorption delaying agents, and the like that are physiologically compatible. The term "pharmaceutically acceptable carrier" excludes tissue culture medium comprising bovine or horse serum. Examples of pharmaceutically acceptable carriers include one or more of water, saline, phosphate buffered saline, dextrose, glycerol, ethanol and the like, as well as combinations thereof. In many cases, it will be preferable to include isotonic agents, for example, sugars, polyalcohols such as mannitol, sorbitol, or sodium chloride in the composition. Pharmaceutically acceptable substances include minor amounts of auxiliary substances such as wetting or emulsifying agents, preservatives or buffers, which enhance the shelf life or effectiveness of the domain antibody.

The compositions as described herein may be in a variety of forms. These include, for example, liquid, semi-solid, and solid dosage forms, such as liquid solutions (e.g., injectable and infusible solutions), dispersions or suspensions, powders, liposomes, and suppositories. The preferred form depends on the intended mode of administration and therapeutic application. Typical preferred compositions are in the form of injectable or infusible solutions, such as compositions similar to those used for passive immunization of humans with other antibodies. One mode of administration is parenteral (e.g., intravenous, subcutaneous, intraperitoneal, intramuscular).

Therapeutic compositions typically must be sterile and stable under the conditions of manufacture and storage. The composition can be formulated as a solution, microemulsion, dispersion, liposome, or other ordered structure suitable to high drug concentration. Sterile injectable solutions can be prepared by incorporating the active compound in the required amount in an appropriate solvent with one or a combination of ingredients enumerated above, as required, followed by filter sterilization. Generally, dispersions are prepared by incorporating the active compound into a sterile vehicle that contains a basic dispersion medium and the required other ingredients from those enumerated above. In the case of sterile powders for the preparation of sterile injectable solutions, methods of preparation include vacuum drying and freeze-drying that yields a powder of the active ingredient plus any additional desired ingredient from a previously sterile-filtered solution thereof. The proper fluidity of a solution can be maintained, for example, by the use of a coating such as lecithin, by the maintenance of the required particle size in the case of dispersion and by the use of surfactants.

The domain antibodies described herein can be administered by a variety of methods known in the art, although for many therapeutic applications, the preferred route/mode of administration is intravenous injection or infusion. The polypeptide can also be administered by intramuscular or subcutaneous injection.

As will be appreciated by the skilled artisan, the route and/or mode of administration will vary depending upon the desired results. In certain embodiments, the active compound may be prepared with a carrier that will protect the compound against rapid release, such as a controlled release formulation, including implants, and microencapsulated delivery systems. Domain antibodies are well suited for formulation as extended release preparations due, in part, to their small size, the number of moles per dose can be significantly higher than the dosage of, e.g., full sized antibodies. Biodegradable, biocompatible polymers can be used, such as ethylene vinyl acetate, polyanhydrides, polyglycolic acid, collagen, polyorthoesters, and polylactic acid. Prolonged absorption of injectable compositions can be brought about by including in the composition an agent that delays absorption, for example, monostearate salts and gelatin. Many methods for the preparation of such formulations are patented or generally known to those skilled in the art. See, e.g., *Sustained and Controlled Release Drug Delivery Systems*, J. R. Robinson, ed., Marcel Dekker, Inc., New York, 1978. Additional methods applicable to the controlled or extended release of polypeptide agents such as the monovalent domain antibodies disclosed herein are described, for example, in U.S. Pat. Nos. 6,306,406 and 6,346,274, as well as, for example, in U.S. Patent Publication Nos. US20020182254 and US20020051808, all of which are incorporated herein by reference for all purposes.

Additional active compounds can also be incorporated into the compositions. In certain embodiments, a domain antibody is co-formulated with and/or co-administered with one or more additional therapeutic agents. For example, a domain antibody can be co-formulated and/or co-administered with one or more additional antibodies that bind other targets (e.g., antibodies that bind other cytokines or that bind cell surface molecules), or, for example, one or more cytokines. Such combination therapies may utilize lower dosages of the administered therapeutic agents, thus avoiding possible toxicities or complications associated with the various monotherapies.

The pharmaceutical compositions disclosed herein can include a "therapeutically effective amount" or a "prophylactically effective amount" of a domain antibody. A "therapeutically effective amount" refers to an amount effective, at dosages and for periods of time necessary, to achieve the desired therapeutic result. A therapeutically effective amount of the domain antibody can vary according to factors such as the disease state, age, sex, and weight of the individual, and the ability of domain antibody to elicit a desired response in the individual. A therapeutically effective amount is also one in which any toxic or detrimental effects of the antibody or antibody portion are outweighed by the therapeutically beneficial effects. A "prophylactically effective amount" refers to an amount effective, at dosages and for periods of time necessary, to achieve the desired prophylactic result. Typically, because a prophylactic dose is used in subjects prior to or at an earlier stage of disease, the prophylactically effective amount will be less than the therapeutically effective amount.

Dosage regimens may be adjusted to provide the optimum desired response (e.g., a therapeutic or prophylactic response). For example, a single bolus may be administered, several divided doses may be administered over time or the dose may be proportionally reduced or increased as indicated by the exigencies of the therapeutic situation. It is advantageous to formulate parenteral compositions in dosage unit form for ease of administration and uniformity of dosage. Dosage unit form as used herein refers to physically discrete units suited as unitary dosages for the mammalian subjects to be treated; each unit containing a predetermined quantity of active compound calculated to produce the desired therapeutic effect in association with the required pharmaceutical carrier.

A non-limiting range for a therapeutically or prophylactically effective amount of a domain antibody is 0.1-20 mg/kg, and in an aspect, 1-10 mg/kg. It is to be noted that dosage values can vary with the type and severity of the condition to be alleviated. It is to be further understood that for any particular subject, specific dosage regimens should be adjusted over time according to the individual need and the professional judgment of the administering clinician.

The efficacy of treatment with a domain antibody as described herein is judged by the skilled clinician on the basis of improvement in one or more symptoms or indicators of the disease state or disorder being treated. An improvement of at least 10% (increase or decrease, depending upon the indicator being measured) in one or more clinical indicators is considered "effective treatment," although greater improvements are included, such as about 20%, 30%, 40%, 50%, 75%, 90%, or even 100%, or, depending upon the indicator being measured, more than 100% (e.g., two-fold, three-fold, ten-fold, etc., up to and including attainment of a disease-free state. Indicators can be physical measurements, e.g., enzyme, cytokine, growth factor or metabolite levels, rate of cell growth or cell death, or the presence or amount of abnormal cells. One can also measure, for example, differences in the amount of time between flare-ups of symptoms of the disease or disorder (e.g., for remitting/relapsing diseases, such as multiple sclerosis). Alternatively, non-physical measurements, such as a reported reduction in pain or discomfort or other indicator of disease status can be relied upon to gauge the effectiveness of treatment. Where non-physical measurements are made, various clinically acceptable scales or indices can be used, for example, the Crohn's Disease Activity Index, or CDAI (Best et al. (1976) *Gastroenterology* 70: 439), which combines both physical indicators, such as hematocrit and the number of liquid or very soft stools, among others, with patient-reported factors such as the severity of abdominal pain or cramping and general well-being, to assign a disease score.

The efficacy of treatment for psoriasis, for example, can be monitored using the Salford Psoriasis Index (SPI) or Psoriasis Area Severity Index (PASI). The PASI is most commonly used method to assess psoriasis disease severity in clinical trials, although it can be exceedingly cumbersome for use in daily clinical practice. The method involves the body being divided into four sections (Legs, which have 40% of a person's skin; the Body (trunk area: stomach, chest, back, etc.) with 30%; the Arms (20%); and the Head (10%)). Each of these areas is scored by itself, and then the four scores are combined into the final PASI. For each section, the percent of area of skin involved, is estimated and then transformed into a grade from 0 to 6:

0% of involved area, grade: 0
<10% of involved area, grade: 1
10-29% of involved area, grade: 2
30-49% of involved area, grade: 3
50-69% of involved area, grade: 4
70-89% of involved area, grade: 5
90-100% of involved area, grade: 6

The severity is estimated by four different parameters: Itching, Erythema (redness), Scaling and Thickness (psoriatic skin is thicker than normal skin). Severity parameters are measured on a scale of 0 to 4, from none to maximum.

The sum of all four severity parameters is than calculated for each section of skin, multiplied by the area score for that area and multiplied by weight of respective section (0.1 for head, 0.2 for arms, 0.3 for body and 0.4 for legs). Example: (Ihead+Ehead+Shead+Thead)×Ahead×0.1=Totalhead.

At the end the total PASI is calculated as a sum of PASIs for all four skin sections. Computer-aided measurement of psoriatic lesion area was found to improve the power of the clinical trial, compared to the standard approach. The physician's estimations of the psoriatic lesion area tend to overestimate. The adapted PASI index, where the psoriatic area was not converted into an area grade, but was maintained as a continuous variable, also improved the power of the clinical trial. The modified PASI which involves computer aided area measurement as a continuous variable is named: Computer aided psoriasis continuous area and severity score cPcASI.

The efficacy of treatment for organ transplant rejection can also be monitored. The survival rates of organ transplant patients (currently around 70-85% for 5 years for all transplanted organs) have improved as a result of advances in organ preservation and immunosuppressive treatments. However, organ rejection, especially the acute rejection that occurs in the first few weeks following surgery, as well as chronic graft rejection, is still one of the major causes of functional failure in organ transplantation. Current diagnosis or confirmation of graft rejection following solid organ transplantation requires biopsy of the tissue in order to detect the infiltration of immune cells (e.g., T-cells, macrophages, etc.) into the graft and other pathological changes. Tissue biopsy is not only invasive, but it is associated with increased health risk to the patent and is prone to sampling errors that can lead to false negative results. Alternative non-invasive methods are being developed, such as magnetic resonance imaging (MRI) which can be used to monitor the accumulation of immune cells at the rejected organ (Ho et al., (2004) *Curr. Pharm. Biotech.,* 5: 551-566).

As the term is used herein, "prophylaxis" performed using a composition as described herein is "effective" if the onset or severity of one or more symptoms is delayed or reduced by at least 10%, or abolished, relative to such symptoms in a similar individual (human or animal model) not treated with the composition.

Whereas the domain antibodies described herein bind human CD28, where one is to evaluate its effect in an animal model system, the polypeptide must cross-react with one or more antigens in the animal model system, in an aspect, at high affinity. One of skill in the art can readily determine if this condition is satisfied for a given animal model system and a given domain antibody. If this condition is satisfied, the efficacy of the domain antibody can be examined by administering it to an animal model under conditions which mimic a disease state and monitoring one or more indicators of that disease state for at least a 10% improvement.

10. Animal Models

Domain antibodies as described herein are useful for the treatment of autoimmune disorders in which CD28 signaling is inappropriately active. There are several animal models in which the therapeutic efficacy of a given domain antibody can be assessed, as discussed below.

10.1. Inflammatory Bowel Disease (IBD) Model (CD4$^+$ CD45RB$^{high}$ to SCID or Rag$^{-/-}$ mice)—Chronic Model An IBD model includes using the mucosal immunity and inflammation system discussed by De Winter et al. (1999) *Am. J. Physiol.* 276: G1317-1321. Briefly, IBD is a multifactorial immune disorder of uncertain etiology. Several mouse models of mucosal inflammation that resemble IBD have provided insight into the mechanisms governing both normal and pathological mucosal immune function. In one aspect, the injection into immunodeficient mice of a subset of CD4 (+) T lymphocytes, the CD4(+)CD45RBhigh cells, leads to inflammation of the intestine. Pathogenesis is due in part to the secretion of proinflammatory cytokines. In another aspect, the induction of colitis can be prevented by co-transfer of another CD4(+) subpopulation, the CD4(+)CD45RBlow T cells. This population behaves analogously to the CD4(+) CD45RBhigh population in terms of the acquisition of activation markers and homing to the host intestine. However, their lymphokine profile when activated is different, and anti-inflammatory cytokines secreted and/or induced by CD4(+) CD45RBlow T cells prevent colitis. De Winter et al. provide a description of the adoptive transfer model and the factors that promote and prevent colitis pathogenesis.

10.2. Spontaneous Arthritis Model in KRN TCR Tg Crossed with NOD Mice—Chronic Model A model of organ-specific disease provoked by systemic autoimmunity is provided by Kouskoff et al. (1996) *Cell* 87: 811-822. Rheumatoid arthritis (RA) is a chronic joint disease characterized by leukocyte invasion and synoviocyte activation followed by cartilage and bone destruction. The etiology and pathogenesis of RA are poorly understood. Kouskoff et al. present a spontaneous mouse model of RA, generated by crossing a T cell receptor (TCR) transgenic line with the NOD strain. All offspring develop a joint disease highly reminiscent of RA in man. The trigger for the murine disorder is chance recognition of a NOD-derived major histocompatibility complex (MHC) class II molecule by the transgenic TCR; progression to arthritis involves CD4+ T, B, and probably myeloid cells.

10.3. Mouse Collagen Induced Arthritis—Chronic Model

A mouse model of collagen-induced arthritis is provided by Brand et al. (2004) *Methods Mol. Med.* 102: 295-312. Briefly, collagen-induced arthritis (CIA) is an experimental autoimmune disease that can be elicited in susceptible strains of rodents (rat and mouse) and non-human primates by immunization with type II collagen (CII), the major constituent protein of articular cartilage. After immunization, the animals develop an autoimmune polyarthritis that shares several clinical and histological features with RA. Susceptibility to CIA in rodents is linked to the class II molecules of the major histocompatibility complex (MHC), and the immune response to CII is characterized by both the stimulation of collagen-specific T cells and the production of high titers of antibody specific for both the immunogen (heterologous CII) and the autoantigen (mouse CII). Histologically, murine CIA is characterized by an intense synovitis that corresponds precisely with the clinical onset of arthritis. This experimental data is useful evaluating CIA because of the pathological similarities between CIA and RA.

10.4. Antigen Induced T Cell Proliferation In Vivo—Acute Model

The use of adoptive transfer of T-cell-antigen-receptor-transgenic T cell for the study of T-cell activation in vivo provides a model for antigen-induced T-cell proliferation. Pape et al., (1997) *Immunol. Rev.* 156: 67-78 discuss adoptive transfer of TCR-transgenic T cells uniformly expressing an identifiable TCR of known peptide/MHC specificity can be used to monitor the in vivo behavior of antigen-specific T cells. The system was used to demonstrate that naive T cells are initially activated within the T-cell zones of secondary lymphoid tissue to proliferate in a B7-dependent manner. If adjuvants or inflammatory cytokines are present during this period, enhanced numbers of T cells accumulate, migrate into B-cell-rich follicles, and acquire the capacity to produce IFN-gamma and help B cells produce IgG2a. If inflammation is absent, most of the initially activated antigen-specific T cells disappear without entering the follicles, and the survivors are poor producers of IL-2 and IFN-gamma.

EXAMPLES

Example 1

Selection of Binding Domain Antibodies

Selections of binding domain antibodies (dAbs) were carried out with recombinant human CD28/Fc Chimera (R&D Systems, Abingdon, UK). The domain antibody library used for selections was based on a single human VH framework (V3-23 aka DP47, and JH4b) and a single human VL framework (012/02 aka DPκ9, and Jκ1). The dAb genes were genetically linked to the fd phage gene III protein under the control of the GAS1 leader sequence in the pDOM4 vector (FIG. 1) which contained all the fd genes necessary to generate infective phage particles. The first round of phage selection was performed by premixing phage library (4 pools for the VH libraries [VH11-13, VH14-15, VH16-17, VH18-19] and a single pool for the VK library) with 2% MPBS (Phosphate Buffered Saline supplemented with 2% Marvel dried skim milk powder) and adding CD28-Fc (R&D Systems, UK) to a final concentration of 100 nM. The mixture was incubated for at least 1 hour at room temperature with mixing end-over-end then the antigen-phage complexes captured using protein G Dynabeads (Dynal, Sweden) and washed 8 times with 1 ml PBST (PBS supplemented with 0.1% Tween 20) followed by a singe wash in 1 ml PBS. The washed phage were eluted from the antigen/bead complex by incubating with 0.5 ml of 1 mg/ml trypsin Type XIII from Bovine Pancreas (Sigma Aldrich, UK) in PBS (supplemented with 5 mM Tris-HCl pH 7.4, 0.1 mM $CaCl_2$). Eluted phage were used to infect E. coli and the output phage titres were determined to be between $1\times10^4$ to $1\times10^5$ titer units (t.u.)/ml, wherein t.u./ml is a measure of infective phage particles per ml. A measure of t.u. is determined through the infection of E. coli with phage of a given dilution, followed by growth of infected E. coli on selective agar plates.

A second round of selection was performed using enriched phage recovered from the previous round of selection with a final concentration of 50 nM CD28-Fc followed by capture using protein G beads as described above. Output titres were in the range $1\times10^6$ to $1\times10^9$ t.u./ml.

A third round of selection using 10 nM CD28-Fc followed by capture using protein G beads was performed. The eluted phage titres were in the range of $2\times10^9$ to $8\times10^9$ t.u./ml.

Monoclonal phage ELISAs were carried out following selection rounds 2 and 3. All washes were performed using 3 washes of 250 μl PBST followed by 3 washes of 250 μl PBS. Plates were coated overnight at 4° C. with 1 mg/ml and 0.6 mg/ml CD28-Fc in PBS respectively. Plates were washed, then blocked with 2% MPBS for 1 hour at room temperature. The plates were washed and phage supernatants added to an equal volume of 2% MPBS and incubated for 1 hour at room temperature. The plates were washed and bound phage detected with anti-M13-HRP conjugate (GE Healthcare, UK) diluted 1:5000 in 2% MPBS and incubated for 1 hour at room temperature. The plates were washed and the ELISA developed using SureBlue 1-Component TMB MicroWell Peroxidase solution (KPL Inc, USA). Specific phage were identified by comparison with a plate coated with 1 mg/ml Fc (Sigma Aldrich, UK). After round 2, specific phages were mainly identified in library pools VH14-15, VH18-19 and VK, whereas by round 3, few specific phage remained. All round 2 pools were subcloned into pDOM5 (FIG. 2) and screened as soluble phage. The phage ELISA is shown in FIG. 3.

Example 2

Identification of Sequences for Binding dAbs

Binding dAbs were identified as follows. Ninety-six individual colonies (pDOM5) were picked from each of the VH14-15, VH18-19 and VK outputs and expressed in 200 μL Terrific Broth containing OnEx Autoinduction media (Novagen, UK) overnight at 37° C. with shaking at 250 rpm in Costar 96 Well Cell Culture Clusters (Corning Incorporated, USA). The cultures were centrifuged to pellet the cells and the supernatants assayed by antigen binding ELISA for CD28 binding dAbs. Maxisorp 96 well immunoplates (Nunc, USA) were coated overnight at 4° C. with 1 mg/ml CD28-Fc in PBS then washed. All washes were as described for the phage ELISA. The plates were blocked for 1 hour at room temperature with 200 μl of PBS containing 1% Tween 20 and then washed. The clarified dAb containing culture supernatant was added to the ELISA plate in the presence of either protein A for VH (Sigma, UK) or protein L for VK (Sigma, UK) to increase the ELISA signal strength by cross-linking the VH or VK dAbs respectively. The plates were incubated for 1 hour at room temperature then washed. Bound dAb was detected using a two step process, firstly 9E10 (anti-myc IgG, Sigma-Aldrich, UK) diluted 1:2000 in PBST was added for 1 hour at room temp then washed, followed by anti-mouse Fc-HRP dilute 1:2000 in PBST for 1 hour at room temperature. The plates were washed and the ELISA developed using SureBlue 1-Component TMB MicroWell Peroxidase solution (KPL Inc, USA) and the color allowed to develop. The colorimetric reaction was stopped by the addition of an equal volume of 1 M HCL and the ELISA plate read at 450 nm. CD28 specific clones were identified by comparison to a control plate coated with Fc alone (see FIG. 4 for example of soluble ELISA). All specific clones were DNA sequenced and initially 28 unique clones were identified (see appendix for sequences). An additional two plates of dAb supernatants were screened for binding to CD28-Fc by BIAcore analysis (GE Healthcare, UK). From this screening, an additional 30 unique sequences were identified.

The dAb amino acid sequences in the examples below do not necessarily correspond exactly to the dAb sequences disclosed in the Sequence Listing. In some cases, the dAb amino acid sequences may contain additional amino acid residues at the N-terminus of the protein, which are introduced to facilitate cloning into an expression vector. In Examples 5, et seq., for instance, the amino acid sequence of recombinantly expressed dAbs may contain a Ser Thr sequence at the N-terminus. These additional N-terminal residues are not believed to affect the biological activity of the dAbs.

Example 3

Characterization of dAb Binding Properties

To characterize the binding activity of the sequenced dAbs, all 58 clones were expressed and purified and tested on the BIAcore against a CM5 chip coated with 12500 RU (response units) of CD28-Fc. A total of nine clones showed binding, including DOM21-4, DOM21-6, DOM21-18, DOM21-20, DOM21-22, DOM21-27 and DOM21-28 (see FIG. 5 for BIAcore traces) and DOM21-38 and DOM21-44.

The protein concentrations used for BIAcore analysis were as follows:
DOM21-4 42.3 μM
DOM21-6 68.1 μM
DOM21-18 13.8 μM
DOM21-20 57.5 μM
DOM21-22 19.4 μM
DOM21-27 14.7 μM
DOM21-28 16.6 μM.

Several dAbs disclosed and characterized herein have been aligned to compare sequence identity with observed activity;

```
                    1                                               50
1h-239-891   (1)   DIQMTQSPSSLSASVGDRVTITCRASRPIWPFLEWYQQKPGKAPKLLIYF
 DOM21-18    (1)   DIQMTQSPSSLSASVGDRVTITCRASQYIGTSLNWYQQKPGKAPKLLIYQ
                   51                                              100
1h-239-891  (51)   TSRLHGVPSRFSGSGSGTDFTLTISSLQPEDFATYYCLQNVANPATFSQ
 DOM21-18   (51)   ASLLQSGVPSRFSGSGSGTDFTLTISSLQPEDFATYYCQQLALRPMTFGQ
                   101
1h-239-891 (101)   GTKVEIKR (SEQ ID NO: 476)
 DOM21-18  (101)   GTKVEIKR (SEQ ID NO: 455)
                    1                                               50
1h-239-891   (1)   DIQMTQSPSSLSASVGDRVTITCRASRPIWPFLEWYQQKPGKAPKLLIY
 DOM21-28    (1)   DIQMTQSPSSLSASVGDRVTITCRASQSISHSLVWYQQKPGKAPKLLIY
                   51                                              100
1h-239-891  (51)   TSRLHGVPSRFSGSGSGTDFTLTISSLQPEDFATYYCLQNVANPATFSQ
 DOM21-28   (51)   ASLLQSGVPSRFSGSGSGTDFTLTISSLQPEDFATYYCQQGMTTPFTFGQ
                   101
1h-239-891 (101)   GTKVEIKR (SEQ ID NO: 476)
 DOM21-28  (101)   GTKVEIKR (SEQ ID NO: 456)
                    1                                               50
1h-239-850   (1)   DIQMTQSPSSLSASVGDRVTITCRASRPIWPFLEWYQQKPGKAPKLLIY
 DOM21-28    (1)   DIQMTQSPSSLSASVGDRVTITCRASQSISHSLVWYQQKPGKAPKLLIY
                   51                                              100
1h-239-850  (51)   TSRLQSGVPSRFSGSGSGTDFTLTISSLQPEDFATYYCLQNVMPATFSQ
 DOM21-28   (51)   ASLLQSGVPSRFSGSGSGTDFTLTISSLQPEDFATYYCQQGMTTPFTFGQ
                   101
1h-239-850 (101)   GTKVEIKR (SEQ ID NO: 58)
 DOM21-28  (101)   GTKVEIKR (SEQ ID NO: 456)

1                                               50
1h-239-850   (1)   DIQMTQSPSSLSASVGDRVTITCRASRPIWPFLEWYQQKPGKAPKLLIYF
1h-239-891   (1)   DIQMTQSPSSLSASVGDRVTITCRASRPIWPFLEWYQQKPGKAPKLLIYF
                   51                                              100
1h-239-850  (51)   TSRLQSGVPSRFSGSGSGTDFTLTISSLQPEDFATYYCLQNVMPATFSQ
1h-239-891  (51)   TSRLHGVPSRFSGSGSGTDFTLTISSLQPEDFATYYCLQNVANPATFSQ
                   101
1h-239-850 (101)   GTKVEIKR (SEQ ID NO: 58)
1h-239-891 (101)   GTKVEIKR (SEQ ID NO: 476)
                    1                                               50
1h-99-238    (1)   EVQLLESGGGLVQPGGSLRLSCAASGFTFDSANMSWARQAPGKGLEWVSW
 DOM21-4     (1)   EVQLLESGGGLVQPGGSLRLSCAASGFTFSRYHMSWVRQAPGKGLEWVSV
                   51                                              100
1h-99-238   (51)   ISSGSQTSYADSVKGRFTISRDNSKNTLYLQMNSLRAEDTAVYYCAKSP
 DOM21-4    (51)   ISSLGLQTSYADSVKGRFTISRDNSKNTLYLQMNSLRAEDTAVYYCAEYG
                   101             120
1h-99-238  (101)   FGPLYSFDYRGQGTLVTVSS (SEQ ID NO: 273)
 DOM21-4   (101)   G----SFDYWGQGTLVTVSS (SEQ ID NO: 401)
                    1                                               50
1h-99-238    (1)   EVQLLESGGGLVQPGGSLRLSCAASGFTFDSANMSWARQAPGKGLEWVSW
 DOM21-20    (1)   EVQLLESGGGLVQPGGSLRLSCAASGFTFPAYSMIWVRQAPGKGLEWVST
                   51                                              100
1h-99-238   (51)   IEASSVQTSYADSVKGRFTISRDNSKNTLYLQMNSLRAEDTAVYYCAKSP
 DOM21-20   (51)   ISPLSYSTSYADSVKGRFTISRDNSKNTLYLQMNSLRAEDTAVYYCAEQT
                   101          123
1h-99-238  (101)   FGP---LYGFDYRGQGTLVTVSS (SEQ ID NO: 273)
 DOM21-20  (101)   AYLNRATEHFDYWGQGTLVTVSS (SEQ ID NO: 402)

1                                               50
1h-239-850   (1)   SIQMTQSPSSLSASVGDRNTSSCRASRPIWP--FLEWYQQKPGK-----S
 DOM21-4     (1)   SVQLLES-GGGLVQPGGSSRLSCAASGFTSSRYHMAWVRQAPGKGLEWVS
                   51                                              100
1h-239-850  (44)   PKLLSYFTSRLQSGVPSRFSGSG--TDFTLTSSSLQPEDFATYYCLQN
 DOM21-4    (50)   VIDSSGLQSYYADSVKGRFSISRDNSKNTLYLQMNSLRAEDTAVYYCAEY
                   101 117
1h-239-850  (92)   VSMPATSSQGTKVESKR (SEQ ID NO: 58)
 DOM21-4   (100)   GGAFDYSGQGTLVTSSS (SEQ ID NO: 401)
```

DOM21-18 (VK) and 1h-239-891 (VK) are 82.4% identical.

DOM21-28 (VK) and 1h-239-891 (VK) are 83.3% identical.

DOM21-28 (VK) and 1h-239-850 (VK) are 85.2% identical.

1h-239-891 (VK) and 1h-239-850 (VK) are 96.3% identical.

DOM21-4 (VH) and 1h-99-238 (VH) are 81.7% identical.

DOM21-20 (VH) and 1h-99-238 (VH) are 78.9% identical.

DOM21-4 (VH) and 1h-239-850 (VK) are 23.9% identical.

Example 4

In Vitro dAb Activity Assay

Figure 6:
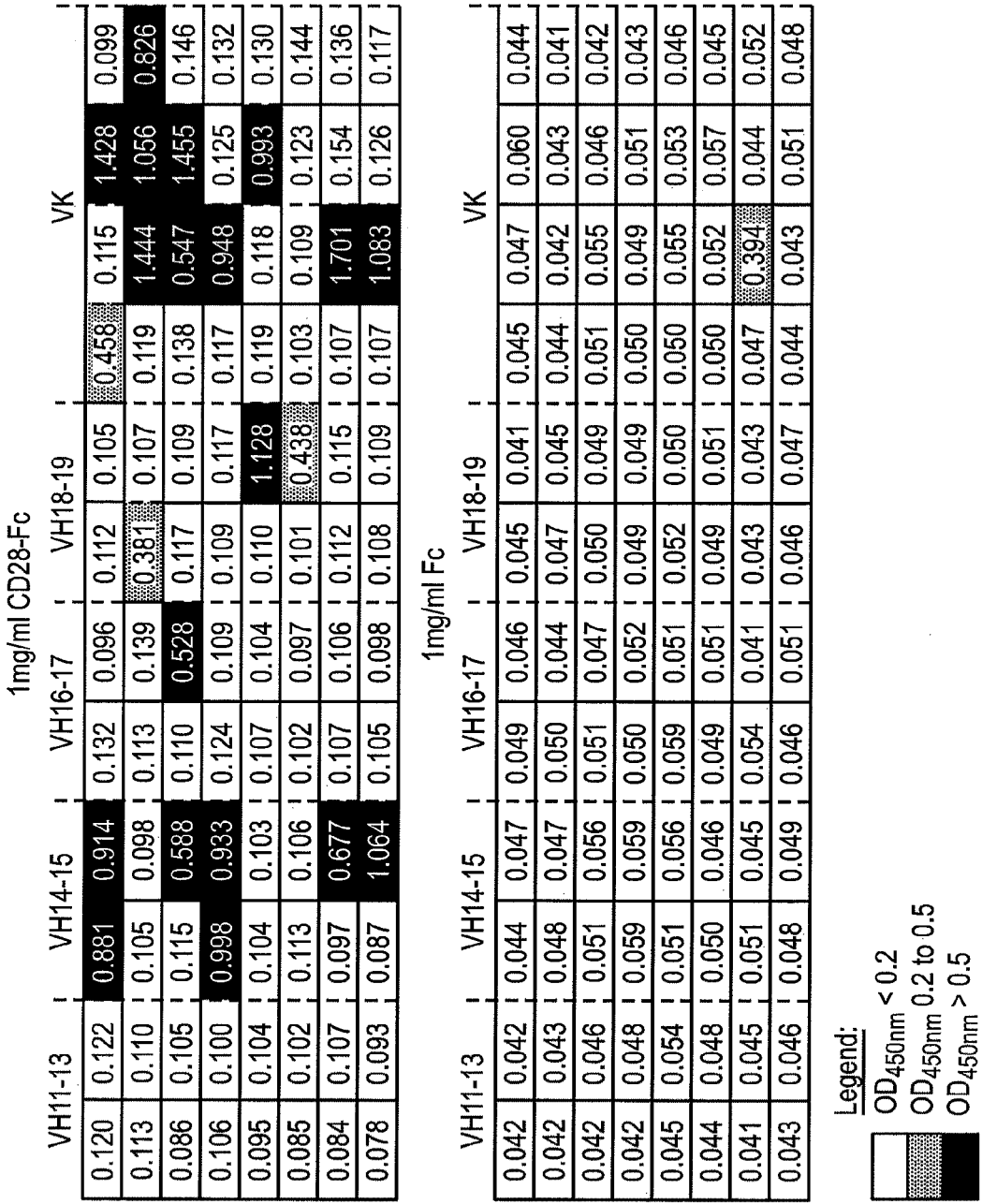
FIG. 6 shows ELISAs of the binding to recombinant human CD28/Fc Chimera and Fc control coated plates of monoclonal phage displaying domain antibody clones.
Figure 7:
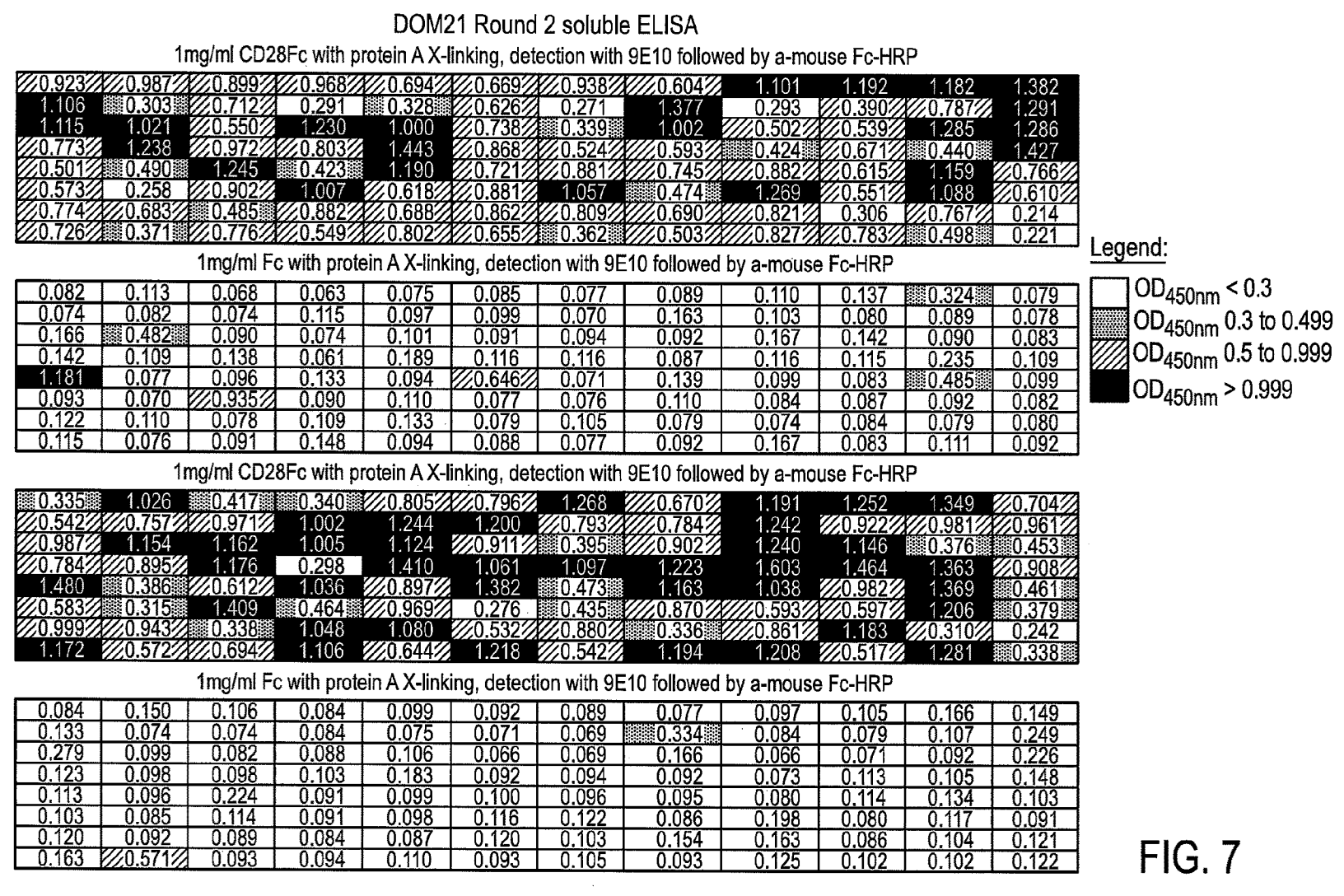
Figure 8:
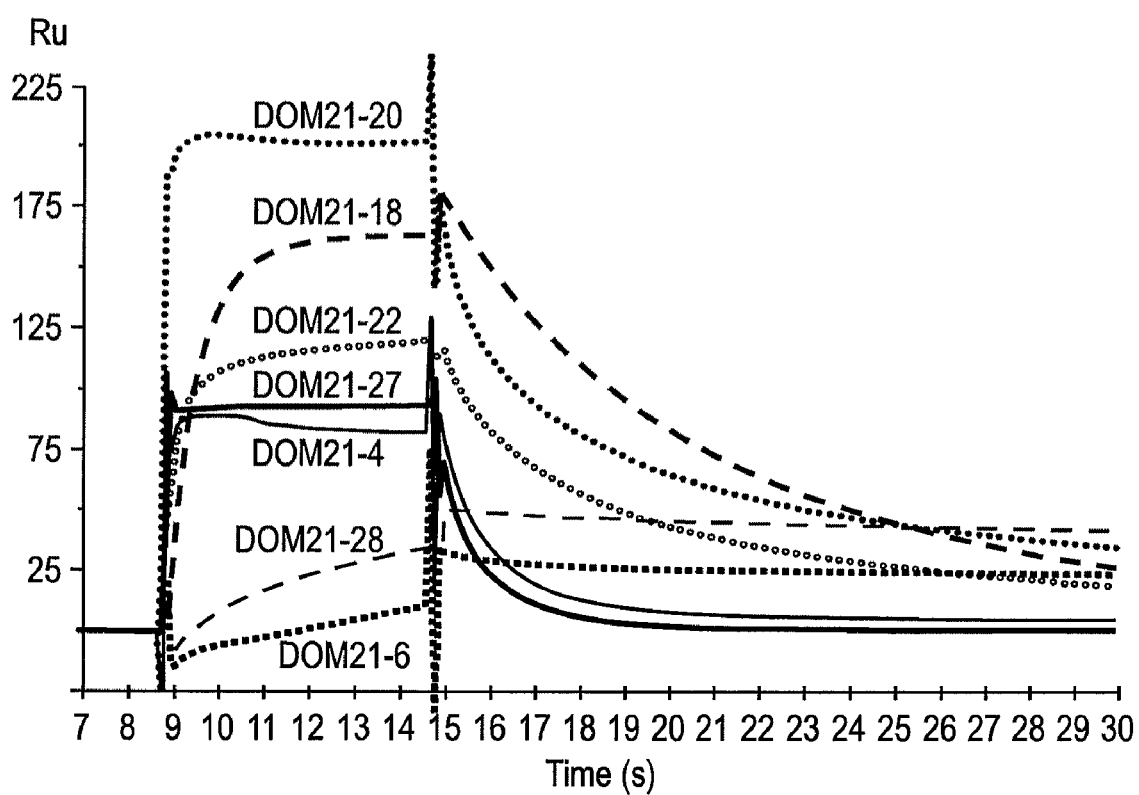
FIG. 8 shows BIAcore traces of dAb clones binding to a CM5 chip coated with 12500 units CD28-Fc.
Figure 9A:
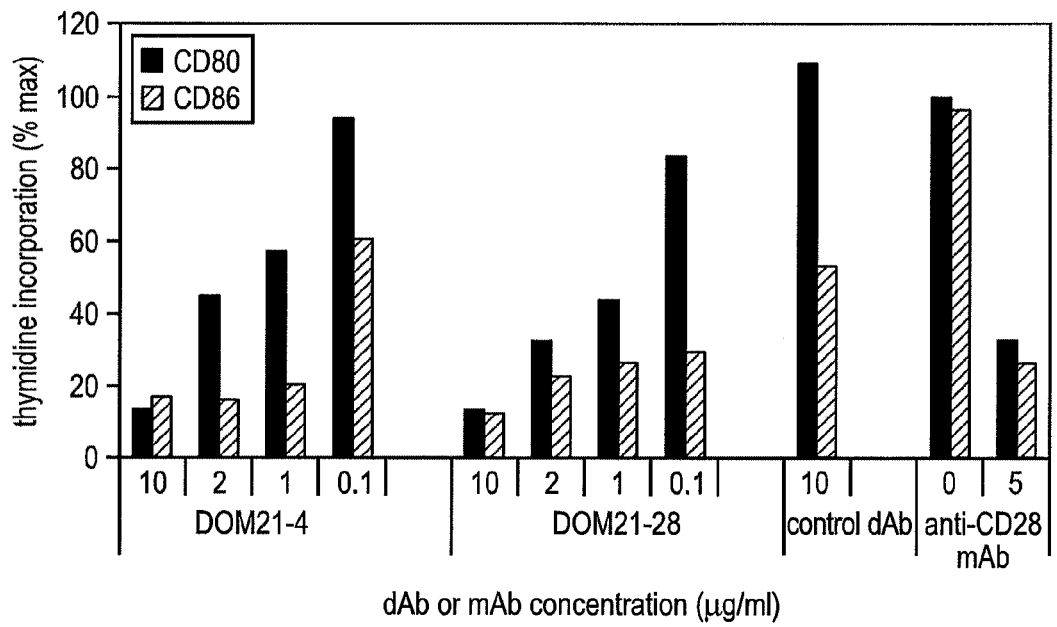
FIG. 9A and FIG. 9B show the ability of domain antibody clones to inhibit the activity of CD28 in duplicate cell based "in vitro" assays. In the assays, human CD4 positive T cells are stimulated with anti-CD3 plus transfected CHO cells expressing either CD80 or CD86.
Figure 9B:
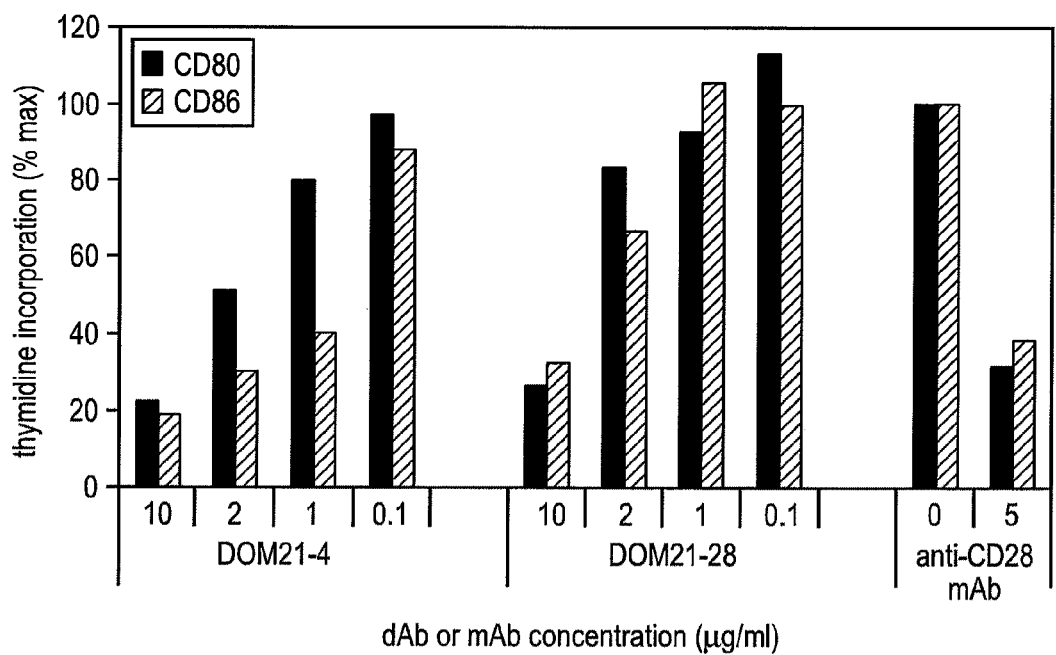

The dAb activity was tested in vitro as follows. Seven of the dAbs (DOM21-4, DOM21-6, DOM21-18, DOM21-20, DOM21-22, DOM21-27 and DOM21-28) were expressed and purified on a larger scale. Endotoxin depleted dAbs samples at a stock concentration of 100 pM were used to determine whether the dAbs could inhibit the activity of CD28 in a cell based in vitro assay similar to that described by Boulougouris, *J. Immunol.* 1998, 161(8): 3919-3924. Proliferation assays were performed in triplicate in 96-well plates in a final volume of 200 µl per well using RPMI 1640 medium containing 10% FCS and antibiotics. Human CD4 positive T-cells ($5 \times 10^4$) were cultured in the presence of 1 µg/ml anti-CD3 antibody (OKT3) plus transfected CHO cells expressing either CD80 or CD86 and dAb or control antibody at a range of concentrations. Assays were incubated at 37° C. for between 18 hours to 72 hours in the presence of 1 µCi [$^3$H]-thymidine per well. Cells were harvested onto 96-well filter plates using a Packard (Meriden, Conn.) 96-well harvester, and [$^3$H]-thymidine uptake was determined via liquid scintillation counting. Four dAbs, DOM21-4, DOM21-18, DOM21-20 and DOM21-28 showed inhibitory activity (FIG. 6) with DOM21-4 and DOM21-28 showing the greatest degree of inhibition (FIG. 7).

The DNA sequence of unique dAbs identified in the receptor binding assay as inhibiting CD28 binding to CD80 or CD86 are detailed below. The amino acid sequences are also set forth below, with CDR regions for various dAbs in bold font.

```
>DOM21-1
                                                       (SEQ ID NO: 1)
GAGGTGCAGCTGTTGGAGTCTGGGGGAGGCTTGGTACAGCCTGGGGGGTCCCTGCGTCT

CTCCTGTGCAGCCTCCGGATTCACCTTTGATGCGTATTCGATGATTTGGGTCCGCCAGG

CTCCAGGGAAGGGTCTAGAGTGGGTCTCAACTATTACTCCGCAGGGTGATAGGACATAC

TACGCAGACTCCGTGAAGGGCCGGTTCACCATCTCCCGCGACAATTCCAAGAACACGCT

GTATCTGCAAATGAACAGCCTGCGTGCCGAGGACACCGCGGTATATTACTGTGCGCAAG

CTGGTTGGAGTTTTGACTACTGGGGTCAGGGAACCCTGGTCACCGTCTCGAGC

>DOM21-2
                                                       (SEQ ID NO: 2)
GAGGTGCAGCTGTTGGAGTCTGGGGGAGGCTTGGTACAGCCTGGGGGGTCCCTGCGTCT

CTCCTGTGCAGCCTCCGGATTCACCTTTGTGGATTATGAGATGGCTTGGGTCCGCCAGG

CTCCAGGGAAGGGTCTAGAGTGGGTCTCAACTATTTCGAATGATGGCGCTGCTACATAC

TACGCAGACTCCGTGAAGGGCCGGTTCACCATCTCCCGCGACAATTCCAAGAACACGCT

GTATCTGCAAATGAACAGCCTGCGTGCCGAGGACACCGCGGTATATTACTGTGCGAAAG

ATGATGCTGCTTTTGACTACTGGGGTCAGGGAGCCCTGGTCACCGTCTCGAGCG

>DOM21-3
                                                       (SEQ ID NO: 3)
GAGGTGCAGCTGTTGGAGTCTGGGGGAGGCTTGGTACAGCCTGGGGGGTCCCTGCGTCT

CTCCTGTGCAGCCTCCGGATTCACCTTTGGTGCGTATTCTATGGGGTGGGCCCGCCAGG

CTCCAGGGAAGGGTCTAGAGTGGGTCTCATGGATTACGGGGAATGGTGGTTCTACATAC

TACGCAGACTCCGTGAAGGGCCGGTTCACCATCTCCCGCGACAATTCCAAGAACACGCT

GTATCTGCAAATGAACAGCCTGCGTGCCGAGGACACCGCGGTATATTACTGTGCGAAAG

CGGAGGAGCCGTTTGACTACTGGGGTCAGGGAACCCTGGTCACCGTCTCGAGC

>DOM21-4
                                                       (SEQ ID NO: 4)
GAGGTGCAGCTGTTGGAGTCTGGGGGAGGCTTGGTACAGCCTGGGGGGTCCCTGCGTCT

CTCCTGTGCAGCCTCCGGATTCACCTTTAGTAGGTATCATATGGCGTGGGTCCGCCAGG

CTCCAGGGAAGGGTCTAGAGTGGGTCTCAGTGATTGATTCTCTTGGTCTTCAGACATAC

TACGCAGACTCCGTGAAGGGCCGGTTCACCATCTCCCGCGACAATTCCAAGAACACGCT

GTATCTGCAAATGAACAGCCTGCGTGCCGAGGACACCGCGGTATATTACTGTGCGGAAT

ATGGTGGTGCGTTTGACTACTGGGGTCAGGGAACCCTGGTCACCGTCTCGAGCG
```

>DOM21-5
(SEQ ID NO: 5)
GAGGTGCAGCTGTTGGAGTCTGGGGGAGGCTTGGTACAGCCTGGGGGGTCCCTGCGTCT

CTCCTGTGCAGCCTCCGGATTCACCTTTACTCATTATTCTATGGGGTGGGTCCGCCAGG

CTCCAGGGAAGGGTCTAGAGTGGGTCTCACATATTACTCCGGATGGTCTTATTACATAC

TACGCAGACTCCGTGAAGGGCCGGTTCACCATCTCCCGCGACAATTCCAAGAACACGCT

GTATCTGCAAATGAACAGCCTGCGTGCCGAGGATACCGCGGTATATTACTGTGCGAAAG

GTAGGTTGGTTGATTTTGACTACTGGGGTCAGGGAACCCTGGTCACCGTCTCGAGCG

>DOM21-6
(SEQ ID NO: 6)
GAGGTGCAGCTGTTGGAGTCTGGGGGAGGCTTGGTACAGCCTGGGGGGTCCCTGCGTCT

CTCCTGTGCAGCCTCCGGATTCACCTTTGAGAATTATGGTATGGCTTGGGTCCGCCAGG

CTCCAGGGAAGGGTCTAGAGTGGGTCTCAAATATTGGTCGGGCTGGTAGTGTTACATAC

TACGCAGACTCCGTGAAGGGCCGGTTCACCATCTCCCGCGACAATTCCAAGAACACGCT

GTATCTGCAAATGAACAGCCTGCGTGCCGAGGACACCGCGGTATATTACTGTGCGAAAG

TTCAGTCGTGGAGGACTTTTGACTACTGGGGTCAGGGAACCCTGGTCACCGTCTCGAGC

>DOM21-7
(SEQ ID NO: 7)
GAGGTGCAGCTGTTGGAGTCTGGGGGAGGCTTGGTACAGCCTGGGGGGTCCCTGCGTCT

CTCCTGTGCAGCCTCCGGATTCACCTTTCCTGCGTATTCTATGGGGTGGGTCCGCCAGG

CTCCAGAGAAGGGTCTAGAGTGGGTCTCATATATTGATGGGCGTGGTGCTGAGACATAC

TACGCAGACTCCGTGAAGGGCCGGTTCACCATCTCCCGCGACAATTCCAAGAACACGCT

GTATCTGCAAATGAACAGCCTGCGCGCCGAGGATACCGCGGTATATTACTGTGCGAAAA

TTGATACTCTGATTTCTGAGTTTGACTACTGGGGTCAGGGAACCCTGGTCACCGTCTCG

AGC

>DOM21-8
(SEQ ID NO: 8)
GAGGTGCAGCTGTTGGAGTCTGGGGGAGGCTTGGTACAGCCTGGGGGGTCCCTGCGTCT

CTCCTGTGCAGCCTCCGGATTCACCTTTCCTAATTATACGATGTGGTGGGTCCGCCAGG

CTCCAGGGAAGGGTCTAGAGTGGGTCTCATCTATTAGTGGTACTGGTCATACTACATAC

TACGCAGACTCCGTGAAGGGCCGGTTCACCATCTCCCGCGACAATTCCAAGAACACGCT

GTATCTGCAAATGAACAGCCTGCGTGCCGAGGATACCGCGGTATATTACTGTGCGAAAT

TTGGGCCTAATAATCCTATGTTTGACTACTGGGGTCAGGGAACCCTGGTCACCGTCTCG

AGC

>DOM21-9
(SEQ ID NO: 9)
GAGGTGCAGCTGTTGGAGTCTGGGGGAGGCTTGGTACAGCCTGGGGGGTCCCTGCGTCT

CTCCTGTGCAGCCTCCGGATTCACCTTTGCGAGTTATGATATGGGTTGGGTCCGCCAGG

CTCCAGGGAAGGGTCTAGAGTGGGTCTCAGCGATTTCGGCGGATGGTACGTTTACATAC

TACGCAGACTCCGTGAAGGGCCGGTTCACCATCTCCCGCGACAATTCCAAGAACACGCT

GTATCTGCAAATGAACAGCCTGCGTGCCGAGGACACCGCGGTATATTACTGTGCGAAAT

CTTCTTTTGATAAGTATAATTTTGACTACTGGGGTCAGGGAACCCTGGTCACCGTCTCG

AGC

-continued

>DOM21-10
(SEQ ID NO: 10)
GAGGTGCAGCTGTTGGAGTCTGGGGGAGGCTTGGTACAGCCTGGGGGGTCCCTGCGTCT

CTCCTGTGCAGCCTCCGGATTCACCTTTGCTAAGTATACGATGTGGTGGGTCCGCCAGG

CTCCAGGGAAGGGTCTAGAGTGGGTCTCAAGTATTGATCCTGTTGGTAATTTGACATAC

TACGCAGACTCCGTGAAGGGCCGGTTCACCATCTCCCGCGACAATTCCAAGAACACGCT

GTATCTGCAAATGAACAGCCTGCGTGCCGAGGACACCGCGGTATATTACTGTGCGAAAA

GGGGGCCGACGTCGTCTAATTTTGACTACTGGGGTCAGGGAACCCTGGTCACCGTCTCG

AGC

>DOM21-11
(SEQ ID NO: 11)
GAGGTGCAGCTGTTGGAGTCTGGGGGAGGCTTGGTACAGCCTGGGGGGTCCCTGCGTCT

CTCCTGTGCAGCCTCCGGATTCACCTTTAGTGAGTATGGTATGAAGTGGGTCCGCCAGG

CTCCAGGGAAGGGTCTAGAGTGGGTCTCAACGATTGATAATGTTGGTTCGGTGACATAC

TACGCAGACTCCGTGAAGGGCCGGTTCACCATCTCCCGCGACAATTCCAAGAACACGCT

GTATCTGCAAATGAACAGCCTGCGTGCCGAGGACACCGCGGTATATTACTGTGCGAAAA

CTACGCCTGTTTTGCTGCCGCTTTTTGACTACTGGGGTCAGGGAACCCTGGTCACCGTC

TCGAGC

>DOM21-12
(SEQ ID NO: 12)
GAGGTGCAGCTGTTGGAGTCTGGGGGAGGCTTGGTACAGCCTGGGGGGTCCCTGCGTCT

CTCCTGTGCAGCCTCCGGATTCACCTTTGATTCTTATAATATGGGTTGGGTCCGCCAGG

CTCCAGGGAAGGGTCTTGAGTGGGTCTCAGCTATTGCGGCTAATGGTCGTGTGACATAC

TACGCAGACTCCGTGAAGGGCCGGTTCACCATCTCCCGCGACAATTCCAAGAACACGCT

GTATCTGCAAATGAACAGCCTGCGTGCCGAGGACACCGCGGTATATTACTGTGCGAAAA

TGACGAATATGGCGTATGGTAGTTTTGACTACTGGGGTCAGGGAACCCTGGTCACCGTC

TCGAGC

>DOM21-13
(SEQ ID NO: 13)
GAGGTGCAGCTGTTGGAGTCTGGGGGAGGCTTGGTACAGCCTGGGGGGTCCCTGCGTCT

CTCCTGTGCAGCCTCCGGATTCACCTTTGATCTGTATTCGATGGCTTGGGTCCGCCAGG

CTCCAGGGAAGGGTCTGGAGTGGGTCTCACATATTGATAGGGCTGGTATGATTACATAC

TACGCAGACTCCGTGAAGGGCCGGTTCACCATCTCCCGCGACAATTCCAAGAACACGCT

GTATCTGCAAATGAACAGCCTGCGTGCCGAGGACACCGCGGTATATTACTGTGCGAAAG

TTTCTAATGCTGTTAATATGCAGTTTGACTACTGGGGTCAGGGAACCCTGGTCACCGTC

TCGAGC

>DOM21-14
(SEQ ID NO: 14)
GAGGTGCAGCTGTTGGAGTCTGGGGGAGGCTTGGTACAGCCTGGGGGGTCCCTGCGTCT

CTCCTGTGCAGCCTCCGGATTCACCTTTGCTAAGTATACGATGTGGTGGGTCCGCCAGG

CTCCAGGGAAGGGTCTAGAGTGGGTCTCAAGTATTGATCCTGTTGGTAATTTGACATAC

TACGCAGACTCCGTGAAGGGCCGGTTCACCATCTCCCGCGACAATTCCAAGAACACGCT

GTATCTGCAAATGAACAGCCTGCGTGCCGAGGACACCGCGGTATATTACTGTGCGAAAC

GTCATAGGCCTTCGACGCAGGATTTTGACTACTGGGGTCAGGGAACCCTGGNCACCGTC

TCGAGC

```
>DOM21-15
                                                  (SEQ ID NO: 15)
GAGGTGCAGCTGTTGGAGTCTGGGGGAGGCTTGGTACAGCCTGGGGGGTCCCTGCGTCT

CTCCTGTGCAGCCTCCGGATTCACCTTTCCTGATTATAAGATGGGTTGGGTCCGCCAGG

CTCCAGGGAAGGGTCTAGAGTGGGTCTCATGGATTGATAAGGGTGGTATTATTACATAC

TACGCAGACTCCGTGAAGGGCCGGTTCACCATCTCCCGCGACAATTCCAAGAACACGCT

GTATCTGCAAATGAACAGCCTGCGTGCCGAGGATACCGCGGTATATTACTGTGCGAAAA

TGTTTCCTAAGTTTCGGCCGGCTTTTGACTACTGGGGTCAGGGAACCCTGGTCACCGTC

TCGAGCG

>DOM21-16
                                                  (SEQ ID NO: 16)
GAGGTGCAGCTGTTGGAGTCTGGGGGAGGCTTGGTACAGCCTGGGGGGTCCCTGCGTCT

CTCCTGTGCAGCCTCCGGATTCACCTTTGAGGATTATGGGATGGGGTGGGTCCGCCAGG

CTCCAGGGAAGGGTCTAGAGTGGGTCTCACATATTAATCGTTCTGGTCTGGTTACATAC

TACGCAGACTCCGTGAAGGGCCGGTTCACCATCTCCCGCGACAATTCCAAGAACACGCT

GTATCTGCAAATGAACAGCCTGCGTGCCGAGGACACCGCGGTATATTACTGTGCGAAAG

TTCTGAATGCTCCTAATTTTAAGTTTGACTACTGGGGTCAGGGAACCCTGGTCACCGTC

TCGAGCG

>DOM21-17
                                                  (SEQ ID NO: 17)
GAGGTGCAGCTGTTGGAGTCTGGGGGAGGCTTGGTACAGCCTGGGGGGTCCCTGCGTCT

CTCCTGTGCAGCCTCCGGATTCACCTTTAATCGTTATGCGATGGGTTGGGTCCGCCAGG

CTCCAGGGAAGGGTCTAGAGTGGGTCTCATGGATTGATGGTAATGGTCTGGTTACATAC

TACGCAGACTCCGTGAAGGGCCGGTTCACCATCTCCCGCGACAATTCCAAGAACACGCT

GTATCTGCAAATGAACAGCCTGCGTGCCGAGGACACCGCGGTATATTACTGTGCGAAAC

GGACTAGGTCTCATTCTGATTCGGGTTGGGCTTTTGACTACTGGGGTCAGGGAACCCTG

GTCACCGTCTCGAGC

>DOM21-18
                                                  (SEQ ID NO: 18)
GACATCCAGATGACCCAGTCTCCATCCTCCCTGTCTGCATCTGTAGGAGACCGTGTCAC

CATCACTTGCCGGGCAAGTCAGTATATTGGTACTTCGTTAAATTGGTACCAGCAGAAAC

CAGGGAAAGCCCCTAAGCTCCTGACCTATCAGGCTTCCTTGTTGCAAAGTGGGGTCCCA

TCACGTTTCAGTGGCAGTGGATCTGGGACAGATTTCACTCTCACCATCAGCAGTCTGCA

ACCTGAAGATTTTGCTACGTACTACTGTCAACAGTTGGCGCTGCGTCCTATGACGTTCG

GCCAAGGGACCAAGGTGGAAATCAAACGGG

>DOM21-19
                                                  (SEQ ID NO: 19)
GAGGTGCAGCTGTTGGAGTCTGGGGGAGGCTTGGTACAGCCTGGGGGGTCCCTGCGTCT

CTCCTGTGCAGCCTCCGGATTCACCTTTGGTAATTATAATATGGGGTGGGTCCGCCAGG

CTCCAGGGAAGGGTCTAGAGTGGGTCTCAGGTATTACGAAGGGTGGTCGGGTGACATAC

TACGCAGACTCCGTGAAGGGCCGGTTCACCATCTCCCGCGACAATTCCAAGAACACGCT

GTATCTGCAAATGAACAGCCTGCGTGCCGAGGATACCGCGGTATATTACTGTGCGAAAT

TGGGTCCGTCGAGGATGCTTAATGAGCCGCTGTTTGACTACTGGGGTCAGGGAACCCTG

GTCACCGTCTCGAGCG
```

>DOM21-20
(SEQ ID NO: 20)
GAGGTGCAGCTGTTGGAGTCTGGGGGAGGCTTGGTACAGCCTGGGGGGTCCCTGCGTCT

CTCCTGTGCAGCCTCCGGATTCACCTTTCCGGCGTATTCGATGATTTGGGTCCGCCAGG

CTCCAGGGAAGGGTCTAGAGTGGGTCTCAACGATTTCGCCGCTGGGTTATTCGACATAC

TACGCAGACTCCGTGAAGGGCCGGTTCACCATCTCCCGCGACAATTCCAAGAACACGCT

GTATCTGCAAATGAACAGCCTGCGTGCCGAGGACACCGCGGTATATTACTGTGCGGAAC

AGACGGCTTATTTGAATCGTGCTACGGAGCATTTTGACTACTGGGGTCAGGGAACCCTG

GTCACCGTCTCGAGCG

>DOM21-21
(SEQ ID NO: 21)
GAGGTGCAGCTGTTGGAGTCTGGGGGAGGCTTGGTACAGCCTGGGGGGTCCCTGCGTCT

CTCCTGTGCAGCCTCCGGATTCACCTTTTCGAAGTATGATATGGCTTGGGTCCGCCAGG

CTCCAGGGAAGGGTCTGGAGTGGGTCTCATCGATTTATGCTATTGGTGGTAATACATAC

TACGCAGACTCCGTGAAGGGCCGGTTCACCATCTCCCGCGACAATTCCAAGAACACGCT

GTATCTGCAAATGAACAGCCTGCGTGCCGAGGACACCGCGGTATATTACTGTGCGAAAT

TGAAGTCGGGGATGCAGACTCGGTTGAATTCTTTTGACTACTGGGGTCAGGGAACCCTG

GTCACCGTCTCGAGCG

>DOM21-22
(SEQ ID NO: 22)
GAGGTGCAGCTGTTGGAGTCTGGGGGAGGCTTGGTACAGCCTGGGGGGTCCCTGCGTCT

CTCCTGTGCAGCCTCCGGATTCACCTTTGAGCTGTATCAGATGGGTTGGGTCCGCCAGG

CTCCAGGGAAGGGTCTAGAGTGGGTCTCAACTATTATGCCTAGTGGTAATCTTACATAC

TACGCAGACTCCGTGAAGGGCCGGTTCACCATCTCCCGCGACAATTCCAAGAACACGCT

GTATCTGCAAATGAACAGCCTGCGTGCCGAGGATACCGCGGTATATTACTGTGCGAAAA

TGTGGTCGTTGAATTTGGGGTTTCATGCGGCTTTTGACTACTGGGGTCAGGGAACCCTG

GTCACCGTCTCGAGC

>DOM21-23
(SEQ ID NO: 23)
GAGGTGCAGCTGTTGGAGTCTGGGGGAGGCTTGGTACAGCCTGGGGGGTCCCTGCGTCT

CTCCTGTGCAGCCTCCGGATTCACCTTTGGGCAGTATGGTATGGGTTGGGTCCGCCAGG

CTCCAGGGAAGGGTCTAGAGTGGGTCTCAGGGATTAGTCCTTCTGGTAATTATACATAC

TACGCAGACTCCGTGAAGGGCCGGTTCACCATCTCCCGCGACAATTCCAAGAACACGCT

GTATCTGCAAATGAACAGCCTGCGTGCCGAGGATACCGCGGTATATTACTGTGCGAAAG

GGAATGGGTCTCTTCCGCCTCGTGGGTCTATTTTTGACTACTGGGGTCAGGGAACCCTG

GTCACCGTCTCGAGCG

>DOM21-24
(SEQ ID NO: 24)
GAGGTGCAGCTGTTGGAGTCTGGGGGAGGCTTGGTACAGCCTGGGGGGTCCCTGCGTCT

CTCCTGTGCAGCCTCCGGATTCACCTTTGGTAATTATAATATGGGGTGGGTCCGCCAGG

CTCCAGGGAAGGGTCTAGAGTGGGTCTCAGGTATTACGAAGGGTGGTCGGGTGACATAC

TACGCAGACTCCGTGAAGGGCCGGTTCACCATCTCCCGCGACAATTCCAAGAACACGCT

GTATCTGCAAATGAACAGCCTGCGTGCCGAGGATACCGCGGTATATTACTGTGCGAAAT

TGGGTCCGTCGAGGATGCTTAATGAGCCGCTGTTTGACTACTGGGGTCAGGGAACCCTG

GTCACCGTCTCGAGCG

-continued

>DOM21-25
(SEQ ID NO: 25)
GAGGTGCAGCTGTTGGAGTCTGGGGGAGGCTTGGTACAGCCTGGGGGGTCCCTGCGTCT

CTCCTGTGCAGCCTCCGGATTCACCTTTGGGACGTATTATATGGGGTGGGCCCGCCAGG

CTCCAGGGAAGGGTCTAGAGTGGGTCTCATCTATTGGGGCTAATGGTGCTCCTACATAT

TACGCAGACTCCGTGAAGGGCCGGTTCACCATCTCCCGCGACAATTCCAAGAACACGCT

GTATCTGCAAATGAACAGCCTGCGTGCCGAGGATACCGCGGTATATTACTGTGCGAAAA

TTCGTTCGCTTAATAGGTGGGCGGAGCCTGTGTTTGACTACTGGGGTCAGGGAACCCTG

GTCACCGTCTCGAGC

>DOM21-26
(SEQ ID NO: 26)
GAGGTGCAGCTGTTGGAGTCTGGGGGAGGCTTGGTACAGCCTGGGGGGTCCCTGCGTCT

CTCCTGTGCAGCCTCCGGATTCACCTTTGCTGATTATTCTATGTATTGGGTCCGCCAGG

CTCCAGGGAAGGGTCTGGAGTGGGTCTCACAGATTAGTCCGGCGGGTTCTTTTACATAC

TACGCAGACTCCGTGAAGGGCCGGTTCACCATCTCCCGCGACAATTCCAAGAACACGCT

GTATCTGCAAATGAACAGCCTGCGTGCCGAGGATACCGCGGTATATTACTGTGCGAAAG

ATTCTAAGTCTTTTGACTACTGGGGTCAGGGAACCCTGGTCACCGTCTCGAGCG

>DOM21-27
(SEQ ID NO: 27)
GACATCCAGATGACCCAGTCTCCATCCTCCCTGTCTGCATCTGTAGGAGACCGTGTCAC

CATCACTTGCCGGGCAAGTCAGAGTATTGGGACGGGTTTACGGTGGTACCAGCAGAAAC

CAGGGAAAGCCCCTATGCTCCTGATCTATCGGGCGTCCATTTTGCAAAGTGGGGTCCCA

TCACGTTTTAGTGGCAGTGGATCTGGGACAGATTTCACTCTCACCATCAGCAGTCTGCA

ACCTGAAGATTTTGCTACGTACTACTGTCAACAGACGACTCTTCAGCCTTTTACGTTCA

GCCAAGGGACTAAGGTGGAAATCAAACGGG

>DOM21-28
(SEQ ID NO: 28)
GACATCCAGATGACCCAGTCTCCATCCTCCCTGTCTGCATCTGTAGGAGACCGTGTCAC

CATCACTTGCCGGGCAAGTCAGTCTATTAGTCATTCGTTAGTTTGGTACCAGCAGAAAC

CAGGGAAAGCCCCTAAGCTCCTGATCTATTGGGCTTCCCTTTTGCAAAGTGGGGTCCCA

TCACGTTTCAGTGGCAGTGGATCTGGGACAGATTTCACTCTCACCATCAGCAGTCTGCA

ACCTGAAGATTTTGCTACGTACTACTGTCAACAGGGTATGACTACGCCTTTTACGTTCG

GCCAAGGGACCAAGGTGGAAATCAAACGGG

>DOM21-30
(SEQ ID NO: 29)
GAGGTGCAGCTGTTGGAGTCTGGGGGAGGCTTGGTACAGCCTGGGGGGTCCCTGCGTCT

CTCCTGTGCAGCCTCCGGATTCACCTTTGATAGTTATGATATGAATTGGGTCCGCCAGG

CTCCAGGGAAGGGTCTAGAGTGGGTCTCACAGATTTCTGCTGATGGTCATTTTACATAC

TACGCAGACTCCGTGAAGGGCCGGTTCACCATCTCCCGCGACAATTCCAAGAACACGCT

GTATCTGCAAATGAACAGCCTGCGTGCCGAGGACACCGCGGTATATTACTGTGCGAAAT

CGCGGAGTAGTTTTGACTACTGGGGTCAGGGAACCCTGGTCACCGTCTCGAGC

>DOM21-31
(SEQ ID NO: 30)
GAGGTGCAGCTGTTGGAGTCTGGGGGAGGCTTGGTACAGCCTGGGGGTCCCTGCGTCT

CTCCTGTGCAGCCTCCGGATTCACCTTTAGGGATTATATGATGGGGTGGGTCCGCCAGG

CTCCAGGGAAGGGTCTAGAGTGGGTCTCACGTATTGATTCTCATGGTAATCGTACATAC

TACGCAGACTCCGTGAAGGGCCGGTTCACCATCTCCCGCGACAATTCCAAGAACACGCT

GTATCTGCAAATGAACAGCCTGCGTGCCGAGGACACCGCGGTATATTACTGTGCGAAAC

ATATGACGGGTTTTGACTACTGGGGTCAGGGAACCCTGGTCACCGTCTCGAGC

>DOM21-32

(SEQ ID NO: 31)
GAGGTGCAGCTGTTGGAGTCTGGGGGAGGCTTGGTACAGCCTGGGGGGTCCCTGCGTCT

CTCCTGTGCAGCCTCCGGATTCACCTTTAGGGAGTATATGATGGGGTGGGTCCGCCAGG

CTCCAGGGAAGGGTCTAGAGTGGGTCTCACGTATTAATGGTGTGGGTAATTCTACATAC

TACGCAGACTCCGTGAAGGGCCGGTTCACCATCTCCCGCGACAATTCCAAGAACACGCT

GTATCTGCAAATGAACAGCCTGCGTGCCGAGGACACCGCGGTATATTACTGTGCGAAAC

ATCAGGTGGGTTTTGACTACTGGGGTCAGGGAACCCTGGTCACCGTCTCGAGC

>DOM21-33

(SEQ ID NO: 32)
GAGGTGCAGCTGTTGGAGTCTGGGGGAGGCTTGGTACAGCCTGGGGGGTCCCTGCGTCT

CTCCTGTGCAGCCTCCGGATTCACCTTTAGTGATTATATGATGGGTTGGGTCCGCCAGG

CTCCAGGGAAGGGTCTAGAGTGGGTCTCACGTATTACGTCTGAGGGTTCGCATACATAC

TACGCAGACTCCGTGAAGGGCCGGTTCACCATCTCCCGCGACAATTCCAAGAACACGCT

GTATCTGCAAATGAACAGCCTGCGTGCCGAGGACACCGCGGTATATTACTGTGCGAAAC

ATACGTCTGGTTTTGACTACTGGGGTCAGGGAACCCTGGTCACCGTCTCGAGC

>DOM21-34

(SEQ ID NO: 33)
GAGGTGCAGCTGTTGGAGTCTGGGGGAGGCTTGGTACAGCCTGGGGGGTCCCTGCGTCT

CTCCTGTGCAGCCTCCGGATTCACCTTTGGGAGGTATATGATGGGTGGGTCCGCCAGG

CTCCAGGGAAGGGTCTGGAGTGGGTCTCACGGATTTCTGGTCCTGGTACGGTTACATAC

TACGCAGACTCCGTGAAGGGCCGGTTCACCATCTCCCGCGACAATTCCAAGAACACGCT

GTATCTGCAAATGAACAGCCTGCGTGCCGAGGACACCGCGGTATATTACTGTGCGAAAC

ATGATACGGGGTTTGACTACTGGGGTCAGGGAACCCTGGTCACCGTCTCGAGC

>DOM21-35

(SEQ ID NO: 34)
GAGGTGCAGCTGTTGGAGTCTGGGGGAGGCTTGGTACAGCCTGGGGGGTCCCTGCGTCT

CTCCTGTGCAGCCTCCGGATTCACCTTTTCTTCTTATGCTATGATTTGGGTCCGCCAGG

CTCCAGGGAAGGGTCTAGAGTGGGTCTCAGAGATTTCTCCTTATGGTAATCATACATAC

TACGCAGACTCCGTGAAGGGCCGGTTCACCATCTCCCGCGACAATTCCAAGAACACGCT

GTATCTGCAAATGAACAGCCTGCGTGCCGAGGACACCGCGGTATATTACTGTGCGAAAC

CTGATCGGCGTTTTGACTACTGGGGTCAGGGAACCCTGGTCACCGTCTCGAGC

>DOM21-36

(SEQ ID NO: 35)
GAGGTGCAGCTGTTGGAGTCTGGGGGAGGCTTGGTACAGCCTGGGGGGTCCCTGCGTCT

CTCCTGTGCAGCCTCCGGATTCACCTTTACTTCGTATGGGATGCAGTGGGTCCGCCAGG

CTCCAGGGAAGGGTCTAGAGTGGGTCTCATCGATTTCTACTGATGGTATGGTTACATAC

TACGCAGACTCCGTGAAGGGCCGGTTCACCATCTCCCGCGACAATTCCAAGAACACGCT

GTATCTGCAAATGAACAGCCTGCGTGCCGAGGATACCGCGGTATATTACTGTGCGAAAC

TTGGGGTTAATTTTGACTACTGGGGTCAGGGAACCCTGGTCACCGTCTCGAGC

>DOM21-37

(SEQ ID NO: 36)
GAGGTGCAGCTGTTGGAGTCTGGGGGAGGCTTGGTACAGCCTGGGGGGTCCCTGCGTCT

CTCCTGTGCAGCCTCCGGATTCACCTTTGGTGATTATATGATGGGTGGGTCCGCCAGG

```
CTCCAGGGAAGGGTCTGGAGTGGGTCTCAATTATTCGTGTGCCTGGTTCGACTACATAC

TACGCAGACTCCGTGAAGGGCCGGTTCACCATCTCCCGCGACAATTCCAAGAACACGCT

GTATCTGCAAATGAACAGCCTGCGTGCCGAGGACACCGCGGTATATTACTGTGCGAAAC

AGAAGGGTGATGAGTTTGACTACTGGGGTCAGGGAACCCTGGTCACCGTCTCGAGC

>DOM21-38
                                              (SEQ ID NO: 37)
GAGGTGCAGCTGTTGGAGTCTGGGGGAGGCTTGGTACAGCCTGGGGGGTCCCTGCGTCT

CTCCTGTGCAGCCTCCGGATTCACCTTTATTCTGTATGATATGCAGTGGGTCCGCCAGG

CTCCAGGGAAGGGTCTAGAGTGGGTCTCACGTATTTCTGCTAATGGTCATGATACATAC

TACGCAGACTCCGTGAAGGGCCGGTTCACCATCTCCCGCGACAATTCCAAGAACACGCT

GTATCTGCAAATGAACAGCCTGCGTGCCGAGGACACCGCGGTATATTACTGTGCGAAAG

GTCCGCATTATTTGTTTGACTACTGGGGTCAGGGAACCCTGGTCACCGTCTCGAGC

>DOM21-39
                                              (SEQ ID NO: 38)
GAGGTGCAGCTGTTGGAGTCTGGGGGAGGCTTGGTACAGCCTGGGGGGTCCCTGCGTCT

CTCCTGCGCAGCCTCCGGATTCACCTTTACTAAGTATTTTATGGGTTGGGTCCGCCAGG

CTCCAGGGAAGGGTCTAGAGTGGGTCTCACTGATTGATCCGCGTGGTCCTCATACATAC

TACGCAGACTCCGTGAAGGGCCGGTTCACCATCTCCCGCGACAATTCCAAGAACACGCT

GTATCTGCAAATGAACAGCCTGCGTGCCGAGGACACCGCGGTATATTACTGTGCGAAAC

AGTTGGGTGAGGAGTTTGACTACTGGGGTCAGGGAACCCTGGTCACCGTCTCGAGC

>DOM21-40
                                              (SEQ ID NO: 39)
GAGGTGCAGCTGTTGGAGTCTGGGGGAGGCTTGGTACAGCCTGGGGGGTCCCTGCGTCT

CTCCTGTGCAGCCTCCGGATTCACCTTTAAGACTTATACGATGAGGTGGGTCCGCCAGG

CTCCAGGGAAGGGTCTAGAGTGGGTCTCAACTATTAATTCGAGTGGTACTTTGACATAC

TACGCAGACTCCGTGAAGGGCCGGTTCACCATCTCCCGCGACAATTCCAAGAACACGCT

GTATCTGCAAATGAACAGCCTGCGTGCCGAGGATACCGCGGTATATTACTGTGCGAAAT

CTAGTTCTTATACGTTTGACTACTGGGGTCAGGGAACCCTGGTCACCGTCTCGAGC

>DOM21-41
                                              (SEQ ID NO: 40)
GAGGTGCAGCTGTTGGAGTCTGGGGGAGGCTTGGTACAGCCTGGGGGGTCCCTGCGTCT

CTCCTGTGCAGCCTCCGGATTCACCTTTGCGATGTATAGTATGAAGTGGGTCCGCCAGG

CTCCAGGGAAGGGTCTAGAGTGGGTCTCATCGATTTCGAATGCTGGTGATATTACATAC

TACGCAGACTCCGTGAAGGGCCGGTTCACCATCTCCCGCGACAATTCCAAGAACACGCT

GTATCTGCAAATGAACAGCCTGCGTGCCGAGGATACCGCGGTATATTACTGTGCGGAAT

CGTTTAGGTCTCGTTATTTTGACTACTGGGGTCAGGGAACCCTGGTCACCGTCTCGAGC

>DOM21-42
                                              (SEQ ID NO: 41)
GAGGTGCAGCTGTTGGAGTCTGGGGGAGGCTTGGTACAGCCTGGGGGGTCCCTGCGTCT

CTCCTGTGCAGCCTCCGGATTCACCTTTGATGATTATCTTATGGGGTGGGTCCGCCAGG

CTCCAGGGAAGGGTCTGGAGTGGGTCTCACTGATTCGTATGAGGGGTTCTGTTACATAC

TACGCAGACTCCGTGAAGGGCCGGTTCACCATCTCCCGCGACAATTCCAAGAACACGCT

GTATCTGCAAATGAACAGCCTGCGTGCCGAGGACACCGCGGTATATTACTGTGCGAAAC

ATTCTCTTACTACTAATCTTTTTGACTACTGGGGTCAGGGAACCCTGGTCACCGTCTCG

AGC
```

-continued

>DOM21-43                                          (SEQ ID NO: 42)
GAGGTGCAGCTGTTGGAGTCTGGGGGAGGCTTGGTACAGCCTGGGGGGTCCCTGCGTCT

CTCCTGTGCAGCCTCCGGATTCACCTTTACTGATTATATGATGGCTTGGGCCCGCCAGG

CTCCAGGGAAGGGTCTAGAGTGGGTCTCAATTATTGGGACTACTGGTACGTGGACATAC

TACGCAGACTCCGTGAAGGGCCGGTTCACCATCTCCCGCGACAATTCCAAGAACACGCT

GTATCTGCAAATGAACAGCCTGCGTGCCGAGGACACCGCGGTATATTACTGTGCGAAAA

CTAATGCGTATGAGAGTGAGTTTGACTACTGGGGTCAGGGAACCCTGGTCACCGTCTCG

AGC

>DOM21-44                                          (SEQ ID NO: 43)
GAGGTGCAGCTGTTGGAGTCTGGGGGAGGCTTGGTACAGCCTGGGGGGTCCCTGCGTCT

CTCCTGTGCAGCCTCCGGATTCACCTTTGCGCGGTATACTATGGTGTGGGTCCGCCAGG

CTCCAGGGAAGGGTCTAGAGTGGGTCTCAGCTATTCATTTTGATGGTCGGACTACATAC

TACGCAGACTCCGTGAAGGGCCGGTTCACCATCTCCCGCGACAATTCCAAGAACACGCT

GTATCTGCAAATGAATAGCCTGCGTGCCGAGGACACCGCGGTATATTACTGTGCGAAAA

ATGAGTGGGCGTCTCTTAAGCATTTTGACTACTGGGGTCAGGGAACCCTGGTCACCGTC

TCGAGC

>DOM21-45                                          (SEQ ID NO: 44)
GAGGTGCAGCTGTTGGAGTCTGGGGGAGGCTTGGTACAGCCTGGGGGGTCCCTGCGTCT

CTCCTGTGCAGCCTCCGGATTCACCTTTGAGGATTATATGATGGGTTGGGTCCGCCAGG

CTCCAGGGAAGGGTCTAGAGTGGGTCTCATTTATTAATCTGCCTGGTGGTCGTACATAC

TACGCAGACTCCGTGAAGGGCCGGTTCACCATCTCCCGCGACAATTCCAAGAACACGCT

GTATCTGCAAATGAACAGCCTGCGTGCCGAGGACACCGCGGTATATTACTGTGCGAAAC

AGACTCATGGGCTGACTGGTTATTTTGACTACTGGGGTCAGGGAACCCTGGTCACCGTC

TCGAGC

>DOM21-46                                          (SEQ ID NO: 45)
GAGGTGCAGCTGTTGGAGTCTGGGGGAGGCTTGGTACAGCCTGGGGGGTCCCTGCGTCT

CTCCTGTGCAGCCTCCGGATTCACCTTTGGTTTGTATGGTATGGCTTGGGCCCGCCAGG

CTCCAGGGAAGGGTCTAGAGTGGGTCTCATCGATTGGGATGCATGGTGATACTACATAC

TACGCAGACTCCGTGAAGGGCCGGTTCACCATCTCCCGCGACAATTCCAAGAACACGCT

GTATCTGCAAATGAACAGCCTGCGTGCCGAGGACACCGCGGTATATTACTGTGCGAAAG

TTTGTGGGGCTACGTATTGTAATTTTGACTACTGGGGTCAGGGAACCCTGGTCACCGTC

TCGAGC

>DOM21-47                                          (SEQ ID NO: 46)
GAGGTGCAGCTGTTGGAGTCTGGGGGAGGCTTGGTACAGCCTGGGGGGTCCCTGCGTCT

CTCCTGTGCAGCCTCCGGATTCACCTTTGGTAAGTATGTTATGGCTTGGGTCCGCCAGG

CTCCAGGGAAGGGTCTAGAGTGGGTCTCAATTATTGATTCCTTGGGTTCTACTACATAC

TACGCAGACTCCGTGAAGGGCCGGTTCACCATCTCCCGCGACAATTCCAAGAACACGCT

GTATCTGCAAATGAACAGCCTGCGTGCCGAGGACACCGCGGTATATTACTGTGCGAAAG

GGGGTTTGTTGGTTCATTATGATTTTGACTACTGGGGTCAGGGAACCCTGGTCACCGTC

TCGAGC

>DOM21-48
(SEQ ID NO: 47)
GAGGTGCAGCTGTTGGAGTCTGGGGGAGGCTTGGTACAGCCTGGGGGGTCCCTGCGTCT

CTCCTGTGCAGCCTCCGGATTCACCTTTGAGGTGTATGGTATGTCTTGGGCCCGCCAGG

CTCCAGGGAAGGGTCTAGAGTGGGTCTCATTGATTGATGCGGGTGGTCGGAATACATAC

TACGCAGACTCCGTGAAGGGCCGGTTCACCATCTCCCGCGACAATTCCAAGAACACGCT

GTATCTGCAAATGAACAGCCTGCGTGCCGAGGATACCGCGGTATATTACTGTGCGAAAT

CGACGACGCGTGCTTATAGTGATTATTTTGACTACTGGGGTCAGGGAACCCTGGTCACC

GTCTCGAGC

>DOM21-49
(SEQ ID NO: 48)
GAGGTGCAGCTGTTGGAGTCTGGGGGAGGCTTGGTACAGCCTGGGGGGTCCCTGCGTCT

CTCCTGTGCAGCCTCCGGATTCACCTTTGAGAATTATGATATGCATTGGGTCCGCCAGG

CTCCAGGGAAGGGTCTAGAGTGGGTCTCAGGGATTACTACGCATGGTAGGCGTACATAC

TACGCAGACTCCGTGAAGGGCCGGTTCACCATCTCCCGCGACAATTCCAAGAACACGCT

GTATCTGCAAATGAACAGCCTGCGTGCCGAGGATACCGCGGTATATTACTGTGCGAAAA

GTGATAATTTGAATATGAATGTGGATTTTGACTACTGGGGTCAGGGAACCCTGGTCACC

GTCTCGAGC

>DOM21-50
(SEQ ID NO: 49)
GAGGTGCAGCTGTTGGAGTCTGGGGGAGGCTTGGTACAGCCTGGGGGGTCCCTGCGTCT

CTCCTGTGCAGCCTCCGGATTCACCTTTATTAAGTATGATATGTGTTGGGCCCGCCAGG

CTCCAGGGAAGGGTCTAGAGTGGGTCTCATGTATTGAGTCTAGTGGTCAGAATACATAC

TACGCAGACTCCGTGAAGGGCCGGTTCACCATCTCCCGCGACAATTCCAAGAACACGCT

GTATCTGCAAATGAACAGCCTGCGTGCCGAGGACACCGCGGTATATTACTGTGCGAAAT

GTCTGAATGATAGTTGTAATGTTCATTTTGACTACTGGGGTCAGGGAACCCTGGTCACC

GTCTCGAGC

>DOM21-51
(SEQ ID NO: 50)
GAGGTGCAGCTGTTGGAGTCTGGGGGAGGCTTGGTACAGCCTGGGGGGTCCCTGCGTCT

CTCCTGTGCAGCCTCCGGATTCACCTTTGGTAATTATAATATGGGGTGGGTCCGCCAGG

CTCCAGGGAAGGGTCTAGAGTGGGTCTCAGATATTGGTCGTTATGGTAGGGTTACATAC

TACGCAGACTCCGTGAAGGGCCGGTTCACCATCTCCCGCGACAATTCCAAGAACACGCT

GTATCTGCAAATGAACAGCCTGCGTGCCGAGGATACCGCGGTATATTACTGTGCGAAAA

CTCAGCGTATGGTTAATCCGTCGCCTTTTGACTACTGGGGTCAGGGAACCCTGGTCACC

GTCTCGAGC

>DOM21-52
(SEQ ID NO: 51)
GAGGTGCAGCTGTTGGAGTCTGGGGGAGGCTTGGTACAGCCTGGGGGGTCCCTGCGTCT

CTCCTGTGCAGCTTCCGGATTCACCTTTGTTAGTTATAGTATGGGTTGGGTCCGCCAGG

CTCCAGGGAAGGGTCTAGAGTGGGTCTCAATTATTTCGGGGCAGGGTACTGTTACATAC

TACGCAGACTCCGTGAAGGGCCGGTTCACCATCTCCCGCGACAATTCCAAGAACACGCT

GTATCTGCAAATGAACAGCCTGCGTGCCGAGGACACCGCGGTATATTACTGTGCGAAAT

CGCCGATGGTTTTTGCTTTGGATGGGAGGTCTTTTGACTACTGGGGTCAGGGAACCCTG

GTCACCGTCTCGAGC

-continued

>DOM21-53
(SEQ ID NO: 52)
GAGGTGCAGCTGTTGGAGTCTGGGGGAGGCTTGGTACAGCCTGGGGGGTCCCTGCGTCT

CTCCTGTACAGCCTCCGGATTCACCTTTTCTGAGTATAGTATGGGGTGGGTCCGCCAGG

CTCCAGGGAAGGGTCTAGAGTGGGTCTCAAGTATTACGCCTGTTGGTGTTTTTACATAC

TACGCAGACTCCGTGAAGGGCCGGTTCACCATCTCCCGCGACAATTCCAAGAACACGCT

GTATCTGCAAATGAACAGCCTGCGTGCCGAGGACACCGCGGTATATTACTGTGCGAAAG

GGAGGCCTGGGCCGCATGGTTGGTCTTTTCGGTTTGACTACTGGGGTCAGGGAACCCTG

GTCACCGTCTCGAGC

>DOM21-54
(SEQ ID NO: 53)
GAGGTGCAGCTGTTGGAGTCTGGGGGAGGCTTGGTACAGCCTGGGGGGTCCCTGCGTCT

CTCCTGTGCAGCCTCCGGATTCACCTTTGGGCAGTATATGATGGGTTGGGTCCGCCAGG

CTCCAGGGAAGGGTCTAGAGTGGGTCTCAACTATTGATAAGTCGGGTTATAGTACATAC

TACGCAGACTCCGTGAAGGGCCGGTTCACCATCTCCCGCGACAATTCCAAGAACACGCT

GTATCTGCAAATGAACAGCCTGCGTGCCGAGGACACCGCGGTATATTACTGTGCGAAAA

GTGGGATTGATTCGCGGGGTCTGATGACTAAGTTTGACTACTGGGGTCAGGGAACCCTG

GTCACCGTCTCGAGC

>DOM21-55
(SEQ ID NO: 54)
GAGGTGCAGCTGTTGGAGTCTGGGGGAGGCTTGGTACAGCCTGGGGGGTCCCTGCGTCT

CTCCTGTGCAGCCTCCGGATTCACCTTTGCTCGTTATCGTATGGCGTGGGTCCGCCAGG

CTCCAGGGAAGGGTCTAGAGTGGGTCTCATCTATTCTGAGTGATGGTGCGGTTACATAC

TACGCAGACTCCGTGAAGGGCCGGTTCACCATCTCCCGCGACAATTCCAAGAACACGCT

GTATCTGCAAATGAACAGCCTGCGTGCCGAGGACACCGCGGTATATTACTGTGCGAAAC

CTGGGGGAATGCGTGGTCTACTCGGGTTACTTTTGACTACTGGGGTCAGGGAACCCTG

GTCACCGTCTCGAGC

>DOM21-56
(SEQ ID NO: 55)
GAGGTGCAGCTGTTGGAGTCTGGGGGAGGCTTGGTACAGCCTGGGGGGTCCCTGCGTCT

CTCCTGTGCAGCCTCCGGATTCACCTTTTTTACGTATACNATGGCTTGGGTCCGCCAGG

CTCCAGGGAAGGGTCTAGAGTGGGTCTCATCTATTACGCCGCTTGGTTATAATACATAC

TACGCAGACTCCGTGAAGGGCCGGTTCACCATCTCCCGCGACAATTCCAAGAACACGCT

GTATCTGCAAATGAACAGCCTGCGTGCCGAGGACACCGCGGTATATTACTGTGCGAAAC

CGTCGGATGTGAAGGTGTCTCCGCTGCCGAGTTTTGACTACTGGGGTCGGGGAACCCTG

GTCACCGTCTCGAGC

>DOM21-57
(SEQ ID NO: 56)
GAGGTGCAGCTGTTGGAGTCTGGGGGAGGCTTGGTACAGCCTGGGGGGTCCCTGCGTCT

CTCCTGTGCAGCCTCCGGATTCACCTTTACTATGTATGGTATGCATTGGGTCCGCCAGG

CTCCAGGGAAGGGTCTAGAGTGGGTCTCATCGATTTCTCAGTATGGTCTTTCTACATAC

TACGCAGATTCCGTGAAGGGCCGGTTCACCATCTCCCGCGACAATTCCAAGAACACGCT

GTATCTGCAAATGAACAGCCTGCGTGCCGAGGACACCGCGGTATATTACTGTGCGAAAG

GGTCTATGAGGCGGGTGTTTAGTAGTTCGGATACTTTTGACTACTGGGGTCAGGGAACC

CTGGTCACCGTCTCGAGC

>DOM21-58
(SEQ ID NO: 57)
GACATCCAGATGACCCAGTCTCCATCCTCCCTGTCTGCATCTGTAGGAGACCGTGTCAC

CATCACTTGCCGGGCAAGTCAGAATATAGGTGATCGGTTACATTGGTACCAGCAGAAAC

CAGGGAAAGCCCCTAAGCTCCTGATCTATCGTATTTCCCGTTTGCAAAGTGGGGTCCCA

TCACGTTTCAGTGGCAGTGGATCTGGGACAGATTTCACTCTCACCATCAGCAGTCTGCA

ACCTGAAGATTTTGCTACGTACTACTGTCAACAGTTTGGGCTGTATCCTACTACGTTCG

GCCAAGGGACCAAGGTGGAAATCAAACGG

DOM21-4
(SEQ ID NO: 401)
EVQLLESGGGLVQPGGSLRLSCAASGFTFSRYHMAWVRQAPGKGLEWVSVIDSLGLQTY

YADSVKGRFTISRDNSKNTLYLQMNSLRAEDTAVYYCAEYGGAFDYWGQGTLVTVSS

DOM21-20
(SEQ ID NO: 402)
EVQLLESGGGLVQPGGSLRLSCAASGFTFPAYSMIWVRQAPGKGLEWVSTISPLGYSTY

YADSVKGRFTISRDNSKNTLYLQMNSLRAEDTAVYYCAEQTAYLNRATEHFDYWGQGTL

VTVSS

DOM21-1
(SEQ ID NO: 403)
EVQLLESGGGLVQPGGSLRLSCAASGFTFDAYSMIWVRQAPGKGLEWVSTITPQGDRTY

YADSVKGRFTISRDNSKNTLYLQMNSLRAEDTAVYYCAQAGWSFDYWGQGTLVTVSS

DOM21-2
(SEQ ID NO: 404)
EVQLLESGGGLVQPGGSLRLSCAASGFTFVDYEMAWVRQAPGKGLEWVSTISNDGAATY

YADSVKGRFTISRDNSKNTLYLQMNSLRAEDTAVYYCAKDDAAFDYWGQGALVTVSS

DOM21-3
(SEQ ID NO: 405)
EVQLLESGGGLVQPGGSLRLSCAASGFTFGAYSMGWARQAPGKGLEWVSWITGNGGSTY

YADSVKGRFTISRDNSKNTLYLQMNSLRAEDTAVYYCAKAEEPFDYWGQGTLVTVSS

DOM21-4
(SEQ ID NO: 406)
EVQLLESGGGLVQPGGSLRLSCAASGFTFSRYHMAWVRQAPGKGLEWVSVIDSLGLQTY

YADSVKGRFTISRDNSKNTLYLQMNSLRAEDTAVYYCAEYGGAFDYWGQGTLVTVSS

DOM21-5
(SEQ ID NO: 407)
EVQLLESGGGLVQPGGSLRLSCAASGFTFTHYSMGWVRQAPGKGLEWVSHITPDGLITY

YADSVKGRFTISRDNSKNTLYLQMNSLRAEDTAVYYCAKGRLVDFDYWGQGTLVTVSS

DOM21-6
(SEQ ID NO: 408)
EVQLLESGGGLVQPGGSLRLSCAASGFTFENYGMAWVRQAPGKGLEWVSNIGRAGSVTY

YADSVKGRFTISRDNSKNTLYLQMNSLRAEDTAVYYCAKVQSWRTFDYWGQGTLVTVSS

DOM21-7
(SEQ ID NO: 409)
EVQLLESGGGLVQPGGSLRLSCAASGFTFPAYSMGWVRQAPEKGLEWVSYIDGRGAETY

YADSVKGRFTISRDNSKNTLYLQMNSLRAEDTAVYYCAKIDTLISEFDYWGQGTLVTVSS

DOM21-8
(SEQ ID NO: 410)
EVQLLESGGGLVQPGGSLRLSCAASGFTFPNYTMWWVRQAPGKGLEWVSSISGTGHTTY

YADSVKGRFTISRDNSKNTLYLQMNSLRAEDTAVYYCAKFGPNNPMFDYWGQGTLVTVSS

DOM21-9

-continued

DOM21-9 (SEQ ID NO: 411)
EVQLLESGGGLVQPGGSLRLSCAASGFTFASYDMGWVRQAPGKGLEWVSAISADGTFTY
YADSVKGRFTISRDNSKNTLYLQMNSLRAEDTAVYYCAKSSFDKYNFDYWGQGTLVTVSS

DOM21-10 (SEQ ID NO: 412)
EVQLLESGGGLVQPGGSLRLSCAASGFTFAKYTMWWVRQAPGKGLEWVSSIDPVGNLTY
YADSVKGRFTISRDNSKNTLYLQMNSLRAEDTAVYYCAKRGPTSSNFDYWGQGTLVTVSS

DOM21-11 (SEQ ID NO: 413)
EVQLLESGGGLVQPGGSLRLSCAASGFTFSEYGMKWVRQAPGKGLEWVSTIDNVGSVTY
YADSVKGRFTISRDNSKNTLYLQMNSLRAEDTAVYYCAKTTPVLLPLFDYWGQGTLVTV
SS

DOM21-12 (SEQ ID NO: 414)
EVQLLESGGGLVQPGGSLRLSCAASGFTFDSYNMGWVRQAPGKGLEWVSAIAANGRVTY
YADSVKGRFTISRDNSKNTLYLQMNSLRAEDTAVYYCAKMTNMAYGSFDYWGQGTLVTV
SS

DOM21-13 (SEQ ID NO: 415)
EVQLLESGGGLVQPGGSLRLSCAASGFTFDLYSMAWVRQAPGKGLEWVSHIDRAGMITY
YADSVKGRFTISRDNSKNTLYLQMNSLRAEDTAVYYCAKVSNAVNMQFDYWGQGTLVTV
SS

DOM21-14 (SEQ ID NO: 416)
EVQLLESGGGLVQPGGSLRLSCAASGFTFAKYTMWWVRQAPGKGLEWVSSIDPVGNLTY
YADSVKGRFTISRDNSKNTLYLQMNSLRAEDTAVYYCAKRHRPSTQDFDYWGQGTLVTV
SS

DOM21-15 (SEQ ID NO: 417)
EVQLLESGGGLVQPGGSLRLSCAASGFTFPDYKMGWVRQAPGKGLEWVSWIDKGGIITY
YADSVKGRFTISRDNSKNTLYLQMNSLRAEDTAVYYCAKMFPKFRPAFDYWGQGTLVTV
SS

DOM21-16 (SEQ ID NO: 418)
EVQLLESGGGLVQPGGSLRLSCAASGFTFEDYGMGWVRQAPGKGLEWVSHINRSGLVTY
YADSVKGRFTISRDNSKNTLYLQMNSLRAEDTAVYYCAKVLNAPNFKFDYWGQGTLVTV
SS

DOM21-17 (SEQ ID NO: 419)
EVQLLESGGGLVQPGGSLRLSCAASGFTFNRYAMGWVRQAPGKGLEWVSWIDGNGLVTY
YADSVKGRFTISRDNSKNTLYLQMNSLRAEDTAVYYCAKRTRSHSDSGWAFDYWGQGTL
VTVSS

DOM21-19 (SEQ ID NO: 420)
EVQLLESGGGLVQPGGSLRLSCAASGFTFGNYNMGWVRQAPGKGLEWVSGITKGGRVTY
YADSVKGRFTISRDNSKNTLYLQMNSLRAEDTAVYYCAKLGPSRMLNEPLFDYWGQGTL
VTVSS

DOM21-20 (SEQ ID NO: 421)
EVQLLESGGGLVQPGGSLRLSCAASGFTFPAYSMIWVRQAPGKGLEWVSTISPLGYSTY
YADSVKGRFTISRDNSKNTLYLQMNSLRAEDTAVYYCAEQTAYLNRATEHFDYWGQGTL

-continued

VTVSS

DOM21-21
(SEQ ID NO: 422)
EVQLLESGGGLVQPGGSLRLSCAASGFTFSKYDMAWVRQAPGKGLEWVSSIYAIGGNTY

YADSVKGRFTISRDNSKNTLYLQMNSLRAEDTAVYYCAKLKSGMQTRLNSFDYWGQGTL

VTVSS

DOM21-22
(SEQ ID NO: 423)
EVQLLESGGGLVQPGGSLRLSCAASGFTFELYQMGWVRQAPGKGLEWVSTIMPSGNLTY

YADSVKGRFTISRDNSKNTLYLQMNSLRAEDTAVYYCAKMWSLNLGFHAAFDYWGQGTL

VTVSS

DOM21-23
(SEQ ID NO: 424)
EVQLLESGGGLVQPGGSLRLSCAASGFTFGQYGMGWVRQAPGKGLEWVSGISPSGNYTY

YADSVKGRFTISRDNSKNTLYLQMNSLRAEDTAVYYCAKGNGSLPPRGSIFDYWGQGTL

VTVSS

DOM21-24
(SEQ ID NO: 425)
EVQLLESGGGLVQPGGSLRLSCAASGFTFGNYNMGWVRQAPGKGLEWVSGITKGGRVTY

YADSVKGRFTISRDNSKNTLYLQMNSLRAEDTAVYYCAKLGPSRMLNEPLFDYWGQGTL

VTVSS

DOM21-25
(SEQ ID NO: 426)
EVQLLESGGGLVQPGGSLRLSCAASGFTFGTYYMGWARQAPGKGLEWVSSIGANGAPTY

YADSVKGRFTISRDNSKNTLYLQMNSLRAEDTAVYYCAKIRSLNRWAEPVFDYWGQGTL

VTVSS

DOM21-26
(SEQ ID NO: 427)
EVQLLESGGGLVQPGGSLRLSCAASGFTFADYSMYWVRQAPGKGLEWVSQISPAGSFTY

YADSVKGRFTISRDNSKNTLYLQMNSLRAEDTAVYYCAKDSKSFDYWGQGTLVTVSS

DOM21-40
(SEQ ID NO: 428)
EVQLLESGGGLVQPGGSLRLSCAASGFTFKTYTMRWVRQAPGKGLEWVSTINSSGTLTY

YADSVKGRFTISRDNSKNTLYLQMNSLRAEDTAVYYCAKSSSYTFDYWGQGTLVTVSS

DOM21-41
(SEQ ID NO: 429)
EVQLLESGGGLVQPGGSLRLSCAASGFTFAMYSMKWVRQAPGKGLEWVSSISNAGDITY

YADSVKGRFTISRDNSKNTLYLQMNSLRAEDTAVYYCAESFRSRYFDYWGQGTLVTVSS

DOM21-42
(SEQ ID NO: 430)
EVQLLESGGGLVQPGGSLRLSCAASGFTFDDYLMGWVRQAPGKGLEWVSLIRMRGSVTY

YADSVKGRFTISRDNSKNTLYLQMNSLRAEDTAVYYCAKHSLTTNLFDYWGQGTLVTVSS

DOM21-43
(SEQ ID NO: 431)
EVQLLESGGGLVQPGGSLRLSCAASGFTFTDYMMAWARQAPGKGLEWVSIIGTTGTWTY

YADSVKGRFTISRDNSKNTLYLQMNSLRAEDTAVYYCAKTNAYESEFDYWGQGTLVTVSS

DOM21-44
(SEQ ID NO: 432)
EVQLLESGGGLVQPGGSLRLSCAASGFTFARYTMVWVRQAPGKGLEWVSAIHFDGRTTY

YADSVKGRFTISRDNSKNTLYLQMNSLRAEDTAVYYCAKNEWASLKHFDYWGQGTLVTV

SS

DOM21-45

-continued (SEQ ID NO: 433)
EVQLLESGGGLVQPGGSLRLSCAASGFTFEDYMMGWVRQAPGKGLEWVSFINLPGGRTY
YADSVKGRFTISRDNSKNTLYLQMNSLRAEDTAVYYCAKQTHGLTGYFDYWGQGTLVTV
SS DOM21-46
(SEQ ID NO: 434)
EVQLLESGGGLVQPGGSLRLSCAASGFTFGLYGMAWARQAPGKGLEWVSSIGMHGDTTY
YADSVKGRFTISRDNSKNTLYLQMNSLRAEDTAVYYCAKVCGATYCNFDYWGQGTLVTV
SS DOM21-47
(SEQ ID NO: 435)
EVQLLESGGGLVQPGGSLRLSCAASGFTFGKYVMAWVRQAPGKGLEWVSIIDSLGSTTY
YADSVKGRFTISRDNSKNTLYLQMNSLRAEDTAVYYCAKGGLLVHYDFDYWGQGTLVTV
SS DOM21-48
(SEQ ID NO: 436)
EVQLLESGGGLVQPGGSLRLSCAASGFTFEVYGMSWARQAPGKGLEWVSLIDAGGRNTY
YADSVKGRFTISRDNSKNTLYLQMNSLRAEDTAVYYCAKSTTRAYSDYFDYWGQGTLVT
VSS DOM21-49
(SEQ ID NO: 437)
EVQLLESGGGLVQPGGSLRLSCAASGFTFENYDMHWVRQAPGKGLEWVSGITTHGRRTY
YADSVKGRFTISRDNSKNTLYLQMNSLRAEDTAVYYCAKSDNLNMNVDFDYWGQGTLVT
VSS DOM21-50
(SEQ ID NO: 438)
EVQLLESGGGLVQPGGSLRLSCAASGFTFIKYDMCWARQAPGKGLEWVSCIESSGQNTY
YADSVKGRFTISRDNSKNTLYLQMNSLRAEDTAVYYCAKCLNDSCNVHFDYWGQGTLVT
VSS DOM21-51
(SEQ ID NO: 439)
EVQLLESGGGLVQPGGSLRLSCAASGFTFGNYNMGWVRQAPGKGLEWVSDIGRYGRVTY
YADSVKGRFTISRDNSKNTLYLQMNSLRAEDTAVYYCAKTQRMVNPSPFDYWGQGTLVT
VSS DOM21-52
(SEQ ID NO: 440)
EVQLLESGGGLVQPGGSLRLSCAASGFTFVSYSMGWVRQAPGKGLEWVSIISGQGTVTY
YADSVKGRFTISRDNSKNTLYLQMNSLRAEDTAVYYCAKSPMVFALDGRSFDYWGQGTL
VTVSS DOM21-53
(SEQ ID NO: 441)
EVQLLESGGGLVQPGGSLRLSCTASGFTFSEYSMGWVRQAPGKGLEWVSSITPVGVFTY
YADSVKGRFTISRDNSKNTLYLQMNSLRAEDTAVYYCAKGRPGPHGWSFRFDYWGQGTL
VTVSS DOM21-54
(SEQ ID NO: 442)
EVQLLESGGGLVQPGGSLRLSCAASGFTFGQYMMGWVRQAPGKGLEWVSTIDKSGYSTY
YADSVKGRFTISRDNSKNTLYLQMNSLRAEDTAVYYCAKSGIDSRGLMTKFDYWGQGTL
VTVSS

DOM21-55

-continued (SEQ ID NO: 443)
EVQLLESGGGLVQPGGSLRLSCAASGFTFARYRMAWVRQAPGKGLEWVSSILSDGAVTY

YADSVKGRFTISRDNSKNTLYLQMNSLRAEDTAVYYCAKPGGNAWSTRVTFDYWGQGTL

VTVSS

DOM21-57

(SEQ ID NO: 444)
EVQLLESGGGLVQPGGSLRLSCAASGFTFTMYGMHWVRQAPGKGLEWVSSISQYGLSTY

YADSVKGRFTISRDNSKNTLYLQMNSLRAEDTAVYYCAKGSMRRVFSSSDTFDYWGQGT

LVTVSS

DOM21-59

(SEQ ID NO: 445)
EVQLLESGGGLVQPGGSLRLSCAASGFTFDSYDMNWVRQAPGKGLEWVSQISADGHFTY

YADSVKGRFTISRDNSKNTLYLQMNSLRAEDTAVYYCAKSRSSFDYWGQGTLVTVSS

DOM21-60

(SEQ ID NO: 446)
EVQLLESGGGLVQPGGSLRLSCAASGFTFRDYMMGWVRQAPGKGLEWVSRIDSHGNRTY

YADSVKGRFTISRDNSKNTLYLQMNSLRAEDTAVYYCAKHMTGFDYWGQGTLVTVSS

DOM21-61

(SEQ ID NO: 447)
EVQLLESGGGLVQPGGSLRLSCAASGFTFREYMMGWVRQAPGKGLEWVSRINGVGNSTY

YADSVKGRFTISRDNSKNTLYLQMNSLRAEDTAVYYCAKHQVGFDYWGQGTLVTVSS

DOM21-62

(SEQ ID NO: 448)
EVQLLESGGGLVQPGGSLRLSCAASGFTFSDYMMGWVRQAPGKGLEWVSRITSEGSHTY

YADSVKGRFTISRDNSKNTLYLQMNSLRAEDTAVYYCAKHTSGFDYWGQGTLVTVSS

DOM21-63

(SEQ ID NO: 449)
EVQLLESGGGLVQPGGSLRLSCAASGFTFGRYMMGWVRQAPGKGLEWVSRISGPGTVTY

YADSVKGRFTISRDNSKNTLYLQMNSLRAEDTAVYYCAKHDTGFDYWGQGTLVTVSS

DOM21-64

(SEQ ID NO: 450)
EVQLLESGGGLVQPGGSLRLSCAASGFTFSSYAMIWVRQAPGKGLEWVSEISPYGNHTY

YADSVKGRFTISRDNSKNTLYLQMNSLRAEDTAVYYCAKPDRRFDYWGQGTLVTVSS

DOM21-65

(SEQ ID NO: 451)
EVQLLESGGGLVQPGGSLRLSCAASGFTFTSYGMQWVRQAPGKGLEWVSSISTDGMVTY

YADSVKGRFTISRDNSKNTLYLQMNSLRAEDTAVYYCAKLGVNFDYWGQGTLVTVSS

DOM21-66

(SEQ ID NO: 452)
EVQLLESGGGLVQPGGSLRLSCAASGFTFGDYMMGWVRQAPGKGLEWVSIIRVPGSTTY

YADSVKGRFTISRDNSKNTLYLQMNSLRAEDTAVYYCAKQKGDEFDYWGQGTLVTVSS

DOM21-67

(SEQ ID NO: 453)
EVQLLESGGGLVQPGGSLRLSCAASGFTFILYDMQWVRQAPGKGLEWVSRISANGHDTY

YADSVKGRFTISRDNSKNTLYLQMNSLRAEDTAVYYCAKGPHYLFDYWGQGTLVTVSS

DOM21-68

(SEQ ID NO: 454)
EVQLLESGGGLVQPGGSLRLSCAASGFTFTKYFMGWVRQAPGKGLEWVSLIDPRGPHTY

YADSVKGRFTISRDNSKNTLYLQMNSLRAEDTAVYYCAKQLGEEFDYWGQGTLVTVSS

DOM21-18

(SEQ ID NO: 455)
DIQMTQSPSSLSASVGDRVTITCRASQYIGTSLNWYQQKPGKAPKLLTYQASLLQSGVP
SRFSGSGSGTDFTLTISSLQPEDFATYYCQQLALRPMTFGQGTKVEIKR

DOM21-28
(SEQ ID NO: 456)
DIQMTQSPSSLSASVGDRVTITCRASQSISHSLVWYQQKPGKAPKLLIYWASLLQSGVP
SRFSGSGSGTDFTLTISSLQPEDFATYYCQQGMTTPFTFGQGTKVEIKR

DOM21-18
(SEQ ID NO: 457)
DIQMTQSPSSLSASVGDRVTITCRASQYIGTSLNWYQQKPGKAPKLLTYQASLLQSGVP
SRFSGSGSGTDFTLTISSLQPEDFATYYCQQLALRPMTFGQGTKVEIKR

DOM21-27
(SEQ ID NO: 458)
DIQMTQSPSSLSASVGDRVTITCRASQSIGTGLRWYQQKPGKAPMLLIYRASILQSGVP
SRFSGSGSGTDFTLTISSLQPEDFATYYCQQTTLQPFTFSQGTKVEIKR

DOM21-28
(SEQ ID NO: 459)
DIQMTQSPSSLSASVGDRVTITCRASQSISHSLVWYQQKPGKAPKLLIYWASLLQSGVP
SRFSGSGSGTDFTLTISSLQPEDFATYYCQQGMTTPFTFGQGTKVEIKR

DOM21-58
(SEQ ID NO: 460)
DIQMTQSPSSLSASVGDRVTITCRASQNIGDRLHWYQQKPGKAPKLLIYRISRLQSGVP
SRFSGSGSGTDFTLTISSLQPEDFATYYCQQFGLYPTTFGQGTKVEIKR

DOM21-30
(SEQ ID NO: 461)
EVQLLESGGGLVQPGGSLRLSCAASGFTFDSYDMNWVRQAPGKGLEWVSQISADGHFTY
YADSVKGRFTISRDNSKNTLYLQMNSLRAEDTAVYYCAKSRSSFDYWGQGTLVTVSS

DOM21-31
(SEQ ID NO: 462)
EVQLLESGGGLVQPGGSLRLSCAASGFTFRDYMMGWVRQAPGKGLEWVSRIDSHGNRTY
YADSVKGRFTISRDNSKNTLYLQMNSLRAEDTAVYYCAKHMTGFDYWGQGTLVTVSS

DOM21-32
(SEQ ID NO: 463)
EVQLLESGGGLVQPGGSLRLSCAASGFTFREYMMGWVRQAPGKGLEWVSRINGVGNSTY
YADSVKGRFTISRDNSKNTLYLQMNSLRAEDTAVYYCAKHQVGFDYWGQGTLVTVSS

DOM21-33
(SEQ ID NO: 464)
EVQLLESGGGLVQPGGSLRLSCAASGFTFSDYMMGWVRQAPGKGLEWVSRITSEGSHTY
YADSVKGRFTISRDNSKNTLYLQMNSLRAEDTAVYYCAKHTSGFDYWGQGTLVTVSS

DOM21-34
(SEQ ID NO: 465)
EVQLLESGGGLVQPGGSLRLSCAASGFTFGRYMMGWVRQAPGKGLEWVSRISGPGTVTY
YADSVKGRFTISRDNSKNTLYLQMNSLRAEDTAVYYCAKHDTGFDYWGQGTLVTVSS

DOM21-35
(SEQ ID NO: 466)
EVQLLESGGGLVQPGGSLRLSCAASGFTFSSYAMIWVRQAPGKGLEWVSEISPYGNHTY
YADSVKGRFTISRDNSKNTLYLQMNSLRAEDTAVYYCAKPDRRFDYWGQGTLVTVSS

DOM21-36
(SEQ ID NO: 467)
EVQLLESGGGLVQPGGSLRLSCAASGFTFTSYGMQWVRQAPGKGLEWVSSISTDGMVTY
YADSVKGRFTISRDNSKNTLYLQMNSLRAEDTAVYYCAKLGVNFDYWGQGTLVTVSS

DOM21-37

```
                                     (SEQ ID NO: 468)
EVQLLESGGGLVQPGGSLRLSCAASGFTFGDYMMGWVRQAPGKGLEWVSIIRVPGSTTY

YADSVKGRFTISRDNSKNTLYLQMNSLRAEDTAVYYCAKQKGDEFDYWGQGTLVTVSS

DOM21-38
                                     (SEQ ID NO: 469)
EVQLLESGGGLVQPGGSLRLSCAASGFTFILYDMQWVRQAPGKGLEWVSRISANGHDTY

YADSVKGRFTISRDNSKNTLYLQMNSLRAEDTAVYYCAKGPHYLFDYWGQGTLVTVSS

DOM21-39
                                     (SEQ ID NO: 470)
EVQLLESGGGLVQPGGSLRLSCAASGFTFTKYFMGWVRQAPGKGLEWVSLIDPRGPHTY

YADSVKGRFTISRDNSKNTLYLQMNSLRAEDTAVYYCAKQLGEEFDYWGQGTLVTVSS

DOM21-56
                                     (SEQ ID NO: 471)
EVQLLESGGGLVQPGGSLRLSCAASGFTFFTYXMAWVRQAPGKGLEWVSSITPLGYNTY

YADSVKGRFTISRDNSKNTLYLQMNSLRAEDTAVYYCAKPSDVKVSPLPSFDYWGRGTL

VTVSS
```

The following additional VH and VK dAbs were prepared, isolated and characterized. The amino acid sequences of various dAbs are set forth below, with CDR1, CDR2, and CDR3 regions for various dAbs in bold font. CDR1, CDR2 and CDR3 amino acid sequences of various dAbs also are separately set forth below.

```
VK dAbs:
1h-239-850
                                     (SEQ ID NO: 58)
DIQMTQSPSSLSASVGDRVTITCRASRPIWPFLEWYQQKPGKAPKLLIYFTSRLQSGVP

SRFSGSGSGTDFTLTISSLQPEDFATYYCLQNVSMPATFSQGTKVEIKR 1h-35
                                     (SEQ ID NO: 59)
DIQMTQSPSSLSASVGDRVTITCRASQYIGSALSWYQQKPGKAPKLLIYRASNLQSGVP

SRFSGSGSGTDFTLTISSLQPEDFATYYCQQLAIRPFTFGQGTKVEIKR 1h-36
                                     (SEQ ID NO: 60)
DIQMTQSPSSLSASVGDRVTITCRASRDIALDLLWYQQKPGKAPKLLIKGWSGLQSGVP

SRFSGSGSGTDFTLTISSLQPEDFATYYCAQGWGRPVTFGQGTKVEIKR 1h-79
                                     (SEQ ID NO: 61)
DIQMTQSPSSLSASVGDRVTITCRASQPIGHSLAWYQQKPGKAPKLLIYWASTLQSGVP

SRFSGSGSGTDFTLTISSLQPEDFATYYCQQMLRTPFTFGQGTKVEIKR 1h-80
                                     (SEQ ID NO: 62)
DIQMTQSPSSLSASVGDRVTITCRASQRIGSNLAWYQQKPGKAPKLLIYWASLLQSGVP

SRFSGSGSGTDFTLTISSLQPEDFATYYCQQTRSAPFTFGQGTKVEIKR 1h-83
                                     (SEQ ID NO: 63)
DIQMTQSPSSLSASVGDRVTITCRASQSIGHSLVWYQQKPGKAPKLLIYWASLLQSGVS

SRFSGSGSGTDFTLTISSLQPEDFATYYCQQSRAAPFTFGQGTKVEIKR 1h-108
                                     (SEQ ID NO: 64)
DIQMTQSPSSLSASVGDRVTITCRASQYIGTALNWYQQKPGKAPKLLIYRRSHLQSGVP

SRFSGSGSGTDFTLTISSLQPEDFATYYCQQIALTPYTFGQGTKVEIKR
```

-continued 1h-203

(SEQ ID NO: 65)
DIQMTQSPSSLSASVGDRVTITCRASQPIGSVLAWYQQKPGKAPKLLIYFSSILQSGVP

SRFSGSGSGTDFTLTISSLQPEDFATYYCQQALRSPFTFGQGTKVEIKR 1h-207

(SEQ ID NO: 66)
DIQMTQSPSSLSASVGDRVTITCRASQYIGTSLAWYQQKPGKAPKLLIYHSSGLQSGVP

SRFSGSGSGTDFTLTISSLQPEDFATYYCQQTALRPFTFGQGTKVEIKR 1h-238

(SEQ ID NO: 67)
DIQMTQSPSSLSASVGDRVTITCRASQHINASLGWYQQKPGKAPKLLIYWASQLQSGVP

SRFSGSGSGTDFTLTISSLQPEDFATYYCQQMVRTPFTFGQGTKVEIKR 1h-239

(SEQ ID NO: 68)
DIQMTQSPSSLSASVGDRVTITCRASQSIYPFLEWYQQKPGKAPKLLIYFTSRLQSGVP

SRFSGSGSGTDFTLTISSLQPEDFATYYCQQNATNPATFGQGTKVEIKR 1h-18-1

(SEQ ID NO: 69)
DIQMTQSPSSLSASVGDRVTITCRASQYIGTSLNWYQQKPGKAPKLLTYQASFLQSGVP

SRFSGSGSGTDFTLTISSLQPEDFATYYCQQLALRPMTFGQGTKVEIKR 1h-18-2

(SEQ ID NO: 70)
DIQMTQSPSSLSASVGDRVTITCRASQYIGTSLNWYQQKPGKAPKLLTYQASLLQSGVP

SRFSGSGYGTDFTLTISSLQPEDFATYYCQQLALRPMTFGQGTKVEIKR 1h-18-3

(SEQ ID NO: 71)
DIQMTQSPSSLSASVGDRVTITCRASQYIGTSLNWYQQKPGKAPKLLTYRASLLQSGVP

SRFSGSGSGTDFTLTISSLQPEDFATYYCQQLALRPMTFGQGTKVEIKR 1h-18-4

(SEQ ID NO: 72)
DIQLTQSPSSLSASVGDRVTITCRASQYIGTSLNWYQQKPGKAPKLLAYQASLLQSGVP

SRFSGSGYGTDFTLTISSLQPEDFATYYCQQLALRPMTFGQGTKVEIKR 1h-18-5

(SEQ ID NO: 73)
DIQMTQSPSSLSASVGDRVTITCRASQYIGTSLNWYQQKPGKAPKLLTYQASLLQSGVP

SRFSGSGSGTDFTLTISSLQPEDFATYYCQQLAMRPMTFGQGTKVEIKW 1h-18-6

(SEQ ID NO: 74)
DIQMTQSPSSLSASVGDRVTITCRASQYIGTSLNWYQQKPGKAPKLLIYQASLLQSGVP

SRFSGSGYGTDFTLTISSLQPEDFATYYCQQLALRPMTFGQGTKVEIKR 1h-28-1

(SEQ ID NO: 75)
DIQMTQSPSSLSASVGDRVTITCRASQSISHSLVWYQQKPGKAPKLLIYWASLLQSGVP

SRFSGSGSGTDFTLTISSLQPEDFATYYCQQGMSTPFTFGQGTKVEIKR 1h-28-2

(SEQ ID NO: 76)
DIQMTQSPSSLSASVGDRVTITCRASQSISHSLVWYQQKPGKAPKLLIYWASLLQSGVP

SRFSGSGSGTDFTLTISSLQPEDFATYYCQQGMTAPFTFGQGTKVEIKR 1h-31

(SEQ ID NO: 77)
DIQMTQSPSSLSASVGDRVTITCRASQSIGYSLAWYQQKPGKAPKLLIYWVSSLQSGVP

SRFSGSGSGTDFTLTISSLQPEDFATYYCQQTQRTPFTFGQGTKVEIKR

-continued 1h-32
(SEQ ID NO: 78)
DIQMTQSPSSLSASVGDRVTITCRASQNIGHGLAWYQQKPGKAPKLLIYWVSLLQSGVP

SRFSGSGSGTDFTLTISSLQPEDFATYYCQQTLSKPFTFGQGTKVEIKR 1h-33
(SEQ ID NO: 79)
DIQMTQSPSSLSASVGDRVTITCRASSNIHNRLNWYQQKPGKAPKLLIYAASSLQSGVP

SRFSGSGSGTDFTLTISSLQPEDFATYYCRQWIQPPWTFGQGTKVEIKR 1h-34
(SEQ ID NO: 80)
DIQMTQSPSSLSASVGDRVTITCRASQYIGTSLAWYQQKPGKAPKLLIYHSSGLQSGVP

LRFSGSGSGTDFTLTISSLQPEDFATYYCQQTALRPFTFGQGTKVEIKR 1h-35
(SEQ ID NO: 81)
DIQMTQSPSSLSASVGDRVTITCRASQYIGSALSWYQQKPGKAPKLLIYRASNLQSGVP

SRFSGSGSGTDFTLTISSLQPEDFATYYCQQLAIRPFTFGQGTKVEIKR 1h-35-15
(SEQ ID NO: 82)
DIQMTQSPSSLSASVGDRVTITCRASQYIGSALGWYLQKPGKAPKLLIYRASNLQSGVP

SRFSGSGYGTDFTLTISSLQPEDFATYYCQQLAIRPFTFGQGTKVEIKR 1h-35-2
(SEQ ID NO: 83)
DIQMTQSPSSLSASVGDRVTITCRASQYIGSALGWYQQKPGKAPKLLIYRASHLQSGVP

SRFSGSGSGTDFTLTISSLQPEDFATYYCQQLAIRPFTFGQGTKVEIKR 1h-35-5
(SEQ ID NO: 84)
DIQMTQSPSSLSASVGDRVTITCRASQYIGSAISWYQQKPGRAPKLLIYRASYLQSGVP

SRFSGSGSGTDFTLTISSLQPEDFATYYCQQLAIRPFTFGQGTKVGIKR 1h-35-7
(SEQ ID NO: 85)
DIQMTQSPSSLSASVGDRVTITCRASQYIGSALGWYQQKPGKAPKLLIYRASNLQSGVP

SRFSGSGYGTGFTLTISSLQPEDFATYYCQQLAIRPFTFGQGTKVEIKR 1h-35-9
(SEQ ID NO: 86)
DIQMTQSPSSLSASVGDRVTITCRASQYIGSALGWYQQKPGKAPKLLIYRASNMQSGVP

SRFSGSGSGTDFTLTISSLQPEDFATYYCQQLAIRPFTFGQGTKVEIKR 1h-36
(SEQ ID NO: 87)
DIQMTQSPSSLSASVGDRVTITCRASRDIALDLLWYQQKPGKAPKLLIKGWSGLQSGVP

SRFSGSGSGTDFTLTISSLQPEDFATYYCAQGWGRPVTFGQGTKVEIKR 1h-36-1
(SEQ ID NO: 88)
DIQMTQSPSSLSASVGDRVTITCRASRDIALDILWYQQKPGKAPKLLIKGWSGLQSGVP

SRFSGSGSGTDFTLTISSLQPEDFATYYCARGWGRPVTFGQGTKVEIKR 1h-36-2
(SEQ ID NO: 89)
DIQMTQSPSSLSASVGDRVTITCRASRDIALDILWYQQKPGKAPKLLIKGWSGLQSEVP

SRFSGSGSGTDFTLTISSLQPEDFATYYCAKGWGRPVTFGQGTKVEIKR 1h-36-3
(SEQ ID NO: 90)
DIQMTQSPSSLSASVGDRVTITCRASRDIALDLMWYQQKPGKAPKLLIKGWSGLQSGVP

SRFSGSGSGTDFTLTISSLQPEDFATYYCAQGWGRPVTFGQGTKVEIKR

-continued 1h-36-4

(SEQ ID NO: 91)
DIQMTQSPSSLSASVGDRVTITCRASRDIALDLSWYQHKPGKAPKLLIKGWSGLQSGVP

SRFSGSGSGTDFTLTINSLQPEDFATYYCAQGWRPVTFGQGTKVEIKR 1h-36-5

(SEQ ID NO: 92)
DIQMTQSPSSLSASVGDRVTITCRASRDIALDLSWYQQKPGRAPKLLIKGWSGLQSGVP

SRFSGSGSGTDFTLTISSLQPEDFATYYCAQGWRPETFGQGTKVEIKR 1h-36-6

(SEQ ID NO: 93)
DIQMTQSPSSLSASVGDRVTITCRASRDIALDLLWYQLKPGKAPKLLIKGWSGLQSGVP

SRFSGSGSGTDFTLTISSLQPEDFATYFCAQGWRPVTFGQGTKVEIKR 1h-36-7

(SEQ ID NO: 94)
DIQMTQSPSSLSASVGDRVTITCRASRDIALDLLWYQQKPGKAPKLLIKGWSGLQSGVP

SRFSGSGSGTDFTLTISSLQPEDFATYYCAQGWRPATFGQGTKVEIKR 1h-38

(SEQ ID NO: 95)
DIQMTQSPSSLSASVGDRVTITCRASQPIGSVLAWYQQKPGKAPKLLIYFSSILQSGVP

SRFSGSGSGTDFTLTISGLQPEDFATYYCQQALRSPFTFGQGTKVEIKR 1h-39

(SEQ ID NO: 96)
DIQMTQSPSSLSASVGDRVTITCRASQYIGTALHWYQQKPGKAPRLLIYLSSNLQSGVP

SRFSGSGSGTDFTLTISSLQPEDFATYYCQQSALNPYTFGQGTKVEIKR 1h-69

(SEQ ID NO: 97)
DIQMTQSPSSLSASVGDRVTITCRASQKIGTGLRWYQQKPGKAPKLLIYRASVLQSGVP

SRFSGSGSGTDFTLTISSLQPEDFATYYCQQTAFPPYTFGQGTKVEIKR 1h-70

(SEQ ID NO: 98)
DIQMTQSPSSLSASVGDRVTITCRASQSIGTGLRWYQQKPGKAPMLLIYRASILQSGVP

SRFSGGGSGTDFTLTISSLQPEDFATYYCQQTWYRPYTFGQGTKVEIKR 1h-71

(SEQ ID NO: 99)
DIQMTQSPSSLSASVGDRVTITCRASRDIGHMLNWYQQKPGKAPKLLIWFGSVLQSGVP

SRFSGSGSGTDFTLTISSLQPEDFATYYCVQGRLRPPTFGQGTKVEIKR 1h-72

(SEQ ID NO: 100)
DIQMTQSPSSLSASVGDRVTITCRASRSINHWLDWYQQKPGKAPTLLISGVSWLQSGVP

SRFSGSGSGTDFTLTISSLQPEDFATYYCCQPGFRPCTFGQGTKVEIKR 1h-73

(SEQ ID NO: 101)
DIQMTQSPSSLSASVGDRVTITCRASQYIGTQLSWYQQKPGKAPKLLIYRGSLLQSGVP

SRFSGSGSGTDFTLTISSLQPEDFATYYCQQTALSPYTFGQGTKVEIKR 1h-74

(SEQ ID NO: 102)
DIQMTQSPSSLSASVGDRVTITCRASQYIGGALSWYQQKPGKAPKLLIYRASRLQSGVP

SRFSGSGSGTDFTLTISSLQPEDFATYYCQQVALVPYTFGQGTKVEIKR 1h-75

(SEQ ID NO: 103)
DIQMTQSPSSLSASVGDRVTITCRASQYIGTRLSWYQQKPGKAPKLLIYNASFLQSGVP

SRFSGSGSGTDFTLTISSLQPEDFATYYCQQLALSPLTFGQGTKVEIKR 1h-76
(SEQ ID NO: 104)
DIQMTQSPSSLSASVGDRVTITCRASQYIGTRLVWYQQKPGKAPKLLIYQSSLLQSGVP

SRFRGSGSGTDFTLTISSLQPEDSATYYCQQTALVPYTFGQGTKVEIKR 1h-77
(SEQ ID NO: 105)
DIQMTQSPSSLSASVGDRVTITCRASQSIYPFLEWYQQKPGKAPRLLIYFTSRLQSGVP

SRFSGSGSGTDFTLTISSLQPEDFATYYCQQSASMPITFGQGTKVEIKR 1h-78
(SEQ ID NO: 106)
DIQMTQSPSSLSASVGDRVTITCRASQNIGHMLAWYQQKPGKAPKLLIYWGSLLQSGVP

SRFSGSGSGTDFTLTISSLQPEDFATYYCQQARAAPFTFGQGTKVEIKR 1h-79
(SEQ ID NO: 107)
DIQMTQSPSSLSASVGDRVTITCRASQPIGHSLAWYQQKPGKAPKLLIYWASTLQSGVP

SRFSGSGSGTDFTLTISSLQPEDFATYYCQQMLRTPFTFGQGTKVEIKR 1h-79-1
(SEQ ID NO: 108)
DIQMTQSPSSLSASVGDRVTITCRASQPIGHSFGWYQQKPGKAPKLLIYWASTLQSGVP

TRFSGSGSGTDFTLTISSLQPEDFATYYCQQMLRTPFTFGQGTKVEIKR 1h-79-10
(SEQ ID NO: 109)
DIQMTQSPSSLSASVGDRVTITCRASQPIGHSLGWYQQKPGKAPKLLFYWASTLQSGVP

SRFSGSGSGTDFTLTISSLQPEDFATYYCQQMLRTPFTFGQGTKVEIKR 1h-79-11
(SEQ ID NO: 110)
DIQMTQSPSSLSASVGDRVTITCRASQPIGHSFGWYQQKPGKAPKLLIYWASTLQSGVP

SRFSGSGSGTDFTLTISSLQPEDLATYYCQQMLRTPFTFGHGTKVEIKR 1h-79-15
(SEQ ID NO: 111)
DIQMTQSPSSLSASVGDRVTITCRASQPIGHSLGWYQQKPGKAPKLLIYWASTLQSGVP

SRFSGSGSGTDFTITISSLQPEDFATYYCQQMLRTPFTFGQGTKVEIKR 1h-79-1505
(SEQ ID NO: 112)
DIQMTQSPSSLSASVGDRVTITCRASQPIGHSLGWYQQKPGKAPKLLIYWGSWLQSGVP

SRFSGSGSGTDFTLTISSLQPEDFATYYCQQMLRTPFTFGQGTKVEIKR 1h-79-1512
(SEQ ID NO: 113)
DIQMTQSPSSLSASVGDRVTITCRASQPIGHSLGWYQQKPGKAPKLLIYWASVLLHGVP

SRFSGSGSGTDFTLTISSLQPEDFATYYCQQMLRTPFTFGQGTKVEIKR 1h-79-1519
(SEQ ID NO: 114)
DIQMTQSPSSLSASVGDRVTITCRASQPIGHSLGWYQQKPGKAPKLLIYWASLLLDGVP

SRFSGSGSGTDFTLTISSLQPEDFATYYCQQMLRTPFTFGQGTKVEIKR 1h-79-1520
(SEQ ID NO: 115)
DIQMTQSPSSLSASVGDRVAITCRASQPIGHSLGWYEQKPGKAPKLLIYWSSVLISGVP

SRFSGSGSGTDFTLTISSLQPEDFATYYCQQMLRTPFTFGQGTKVEIKR 1h-79-16
(SEQ ID NO: 116)
DIQMTQSPSSLSASVGDRVTITCRASQPIGHSFAWYQQKPGKAPKLLIYWASTLQSGVP

SRFSGSGSGTDFTLTISSLQPEDFATYFCQQMLRTPFTFGQGTKVEIKR

-continued 1h-79-17
(SEQ ID NO: 117)
DIQMTQSPSSLSASVGDRVTITCRASQPIGHSLAWYQQKPGKAPKLLIYWASTLQSGVP

SRFSGSGSGTDFTLTISSLQPEDFATYYCQQMLRTPFAFGQGTKVEIKR 1h-79-18
(SEQ ID NO: 118)
DIQMTQSSSSLSASVGDRVSITCRASQPIGHSLGWYQQKPGKAPKLLIYWASTLQSGVP

SRFSGSGSGTDFTLTISSLQPADSATYYCQQMLRTPFTFGQGTKVEIKR 1h-79-19
(SEQ ID NO: 119)
DIQMTQSPSSRSASVGDRVTITCRASQPIGHSLGWYQQKPGKAPKLLIYWASTLQSGVP

SRFSGSGSGTDFTLTISSLQPEDFATYYCQQMLRTPFTFGQGTKVEIKR 1h-79-2
(SEQ ID NO: 120)
DTQMTQSPSSLSASVGDRVTITCRASRPIGHSLGWYQQKPGKAPKLLIYWASMLQSGVP

SRFSGSGSGTDFTLTISSLQPEDFATYYCQQMLRTPFTFGQGTKVEIKR 1h-79-20
(SEQ ID NO: 121)
DIQMTQSPSSLSASVGDRVTVTCRASQPIGHSLAWYQQKPGKAPKLLIYWASMLQSGVP

SRFSGSGSGTDFTLTISSLQPEDFATYYCQQMLRTPFTFGQGTKVEIKR 1h-79-21
(SEQ ID NO: 122)
DIQMTQSPSSLSASVGDRVTITCRASQPIGHSFAWYQQKPGKAPKLLIYWASTLQSGVP

SRFSGSGSGTDFTLTISSLQPEDFATYYCQQMLRTPFTFGQGTKVEIKR 1h-79-22
(SEQ ID NO: 123)
DIQMTQSPSSLSASVGDRVTITCRASQPIGHSLAWYQQKPGKAPKLLIYWASMLQSGVP

SRFSGSGSGTDFTLTISSLQPEDFATYYCQQMLRTPFSFGQGTKVEIKR 1h-79-23
(SEQ ID NO: 124)
DIQMTQSPSSLSASVGDRVTITCRASQPIGHSFAWYQQKPGKAPKLLIYWASTLQSGVP

SRFSGSGSGTDFTLTISSLQPEDFATYYCQQMLRTPFMFGQGTKVEIKR 1h-79-24
(SEQ ID NO: 125)
DIQMTQSPSSLSASVGDRVTITCRASQPIGHSLGWYQQKPGKAPKLLIYWASTLQSGVP

SRFSGSGSGTDFTLTISSLQPEDFATYYCQQMLRTPFAFGQGTKVEIKR 1h-79-25
(SEQ ID NO: 126)
DIQMTQSPSSLSASVGDRVTITCRASQPIGHSFAWYQQKPGKAPKLLIYWASTLQSGVP

SRFSGSGSGTDFTLTISSLQPEDFATYYCQQMLRTPFAFGQGTKVEIKR 1h-79-26
(SEQ ID NO: 127)
DIQMTQSPSSLSASVGDRVTITCRASQPIGHSLGWYQQKPGKAPKLLIYWASMLQSGVP

SRFSGSGSGTDFTLTISSLQPEDFATYYCQQMLRTPFSFGQGTKVEIKR 1h-79-27
(SEQ ID NO: 128)
DIQMTQSPSSLSASVGDRVTITCRASQPIGHSFAWYQQKPGKAPKLLIYWASMLQSGVP

SRFSGSGSGTDFTLTISSLQPEDFATYYCQQMLRTPFSFGQGTKVEIKR 1h-79-28
(SEQ ID NO: 129)
DIQMTQSPSSLSASVGDRVTITCRASQPIGHSLGWYQQKPGKAPKLLIYWASMLQSGVP

SRFSGSGSGTDFTLTISSLQPEDFATYYCQQMLRTPFMFGQGTKVEIKR

-continued 1h-79-29
(SEQ ID NO: 130)
DIQMTQSPSSLSASVGDRVTITCRASQPIGHSLGWYQQKPGKAPKLLIYWASMLQSGVP

SRFSGSGSGTDFTLTISSLQPEDFATYYCQQMLRTPFAFGQGTKVEIKR 1h-79-3
(SEQ ID NO: 131)
DIQMTQSPSSLSASVGDRVTITCRASQPIGHSLGWYQQKPGKAPKLLIYWASTLQSGVP

SRFSGSGSGTDFTLTISSLRPEDFATYYCQQMLRTPFTFGQGTKVEIKR 1h-79-30
(SEQ ID NO: 132)
DIQMTQSPSSLSASVGDRVTITCRASQPIGHSFGWYQQKPGKAPKLLIYWASMLQSGVP

SRFSGSGSGTDFTLTISSLQPEDFATYYCQQMLRTPFSFGQGTKVEIKR 1h-79-31
(SEQ ID NO: 133)
DIQMTQSPSSLSASVGDRVTITCRASQPIGHSFGWYQQKPGKAPKLLIYWASMLQSGVP

SRFSGSGSGTDFTLTISSLQPEDFATYYCQQMLRTPFMFGQGTKVEIKR 1h-79-32
(SEQ ID NO: 134)
DIQMTQSPSSLSASVGDRVTITCRASQPIGHSFGWYQQKPGKAPKLLIYWASMLQSGVP

SRFSGSGSGTDFTLTISSLQPEDFATYYCQQMLRTPFAFGQGTKVEIKR 1h-79-4
(SEQ ID NO: 135)
DIQMTQSPSSLSASVGDRVTITCRASQPIGHSLGWYQQKPGKAPRLLIYWASTLQSGVP

SRFSGSGSGTDFTLTISSLQPEDFATYYCQQMLRTPFTFGQGTKVEIKR 1h-79-5
(SEQ ID NO: 136)
DIQMTQSPSSLSASVGDRVTITCRASQPIGHSLGWYQQKPGKAPKLLIYWASTLQSGVP

SRFSGSGSGTDFTLTISSLQPEDFATYYCQQMLRTPFTFGQGTKVENKR 1h-79-6
(SEQ ID NO: 137)
DIQMTQSPSSLSASVGDRVTITCRASQPIGHSFAWYQQKPGKAPKLLIYWASTLQSGVP

SRFSGSGSGTDFTLTISSLQREDFATYYCQQMLRTPFTFGQGTKVEIKR 1h-79-7
(SEQ ID NO: 138)
DIQMTQSPSSLSASVGDRVTITCRASQPIGHSLGWYQQKPGKAPKLLTYWASTLQSGVP

SRFSGSGSGTDFTLTISSLQPEDFATYYCQQMLRTPFTFGQGTKVEIKR 1h-79-8
(SEQ ID NO: 139)
DIQMTQSPSSLSASVGDRVTITCRASQPIGHSLGWYQQKPGKAPKLLIYWASTLQSGVP

SRFSGSGSGTDFTLTISSLQPEDFATYYCQQMLRTPFMFGQGTKVEIKR 1h-79-801
(SEQ ID NO: 140)
DIQMTQSPSSLSASVGDRVTITCRASQPIGHSLGWYQQKPGKAPKLLIYWGSDLYKGVP

SRFSGSGSGTDFTLTISSLQPEDFATYYCQQMLRTPFMFGQGTKVEIKR 1h-79-802
(SEQ ID NO: 141)
DIQMTQSPSSLSASVGDRVTITCRASTPIGHSLGWYQQKPGKAPKLLIYWASTLQSGVP

SRFSGSGSGTDFTLTISSLQPEDFATYYCQQMLRTPFMFGQGTKVEIKR 1h-79-803
(SEQ ID NO: 142)
DIQMTQSPSSLSASVGDRVTITCRASQSIGHSLGWYQQKPGKAPKLLIYWASTLQSGVP

SRFSGSGSGTDFTLTISSLQPEDFATYYCQQMLRTPFMFGQGTKVEIKR

-continued 1h-79-804
(SEQ ID NO: 143)
DIQMTQSPSSLSASVGDRVTITCRASKPISHSLGWYQQKPGKAPKLLTYWASTLQSGVP

SRFSGSGSGTDFTLTISSLQPEDFATYYCQQMLRTPFMFGQGTKVEIKR 1h-79-805
(SEQ ID NO: 144)
DIQMTQSPSSLSASVGDRVTITCRASQAIDHSLGWYQQKPGKAPKLLIYWASTLQSGVP

SRFSGSGSGTDFTLTISSLQPEDFATYYCQQMLRTPFMFGQGTKVEIKR 1h-79-806
(SEQ ID NO: 145)
DIQMTQSPSSLSASVGDRVTITCRASQPIGHSLGWYQQKPGKAPKLLIYWASMLQGGVP

SRFSGSGSGTDFTLTISSLQPEDFATYYCQQMLRTPFMFGQGTKVEIKR 1h-79-807
(SEQ ID NO: 146)
DIQMTQSPSSLSASVGDRVTITCRASQPIGHTLGWYQQKPGKAPKLLIYWASDLIRGVP

SRFSGSGSGTDFTLTISSLQPEDFATYYCQQMLRTPFMFGQGTKVEIKR 1h-79-808
(SEQ ID NO: 147)
DIQMTQSPSSLSASVGDRVTITCRASQPIGHALGWYQQKPGKAPRLLIYWASTLQSGVP

SRFSGSGSGTDFTLTISSLQPEDFATYYCQQMLRTPFMFGQGTKVEIKR 1h-79-809
(SEQ ID NO: 148)
DIQMTQSPSSLSASVGDRVTITCRASQAIGHSLGWYQQKPGKAPKLLVYWASTLQSGVP

SRFSGSGSGTDFTLTISSLQPEDFATYYCQQMLRTPFMFGQGTKVEIKR 1h-79-810
(SEQ ID NO: 149)
DIQMTQSPSSLSASVGDRVTITCRASQPIGHSLGWYQQKPGKAPKLLIYWGSDLSYGVP

SRFSGSGSGTDFTLTISSLQPEDFATYYCQQMLRTPFMFGQGTKVEIKR 1h-79-811
(SEQ ID NO: 150)
DIQMTQSPSSLSASVGDRVTITCRASRSIGHSLGWYQQKPGKAPKLLIYWASTLQSGVP

SRFSGSGSGTDFTLTISSLQPEDFATYYCQQMLRTPFMFGQGTKVEIKR 1h-79-812
(SEQ ID NO: 151)
DIQMTQSPSSLSASVGDRVTITCRASSTIGHSLGWYQQKPGKAPKLLIYWASTLQSGVP

SRFSGSGSGTDFTLTISSLQPEDFATYYCQQMLRTPFMFGQGTKVEIKR 1h-79-813
(SEQ ID NO: 152)
DIQMTQSPSSLSASVGDRVTITCRASQPTGHSLGWYQQKPGKAPKLLIYWASTLQSGVP

SRFSGSGSGTDFTLTISSLQPEDFATYYCQQMMRTPFMFGQGTKVEIKR 1h-79-814
(SEQ ID NO: 153)
DIQMTQSPSSLSASVGDRVTITCRASSRIGSSLGWYQQKPGKAPKLLIYWASMLQSGVP

SRFSGSGSGTDFTLTISSLQPEDFATYYCQQMLRTPFMFGQGTKVEIKR 1h-79-815
(SEQ ID NO: 154)
DIQMTQSPSSLSASVGDRVTITCRASRAIGHSLGWYQQKPGKAPKLLIYWASTLQSGVP

SRFSGSGSGTDFTLTISSLQPEDFATYYCQQMLRTPFMFGQGTKVEIKR 1h-79-9
(SEQ ID NO: 155)
DIQMTQSPSSLSASVGDRVTITCRASQPIGHSLGWYQQKPGKAPKLLIYWASTLQSGVP

SRFSGSGSGTDFTLTISSLQPADFATYYCQQMLRTPFTFGRGTKVEIKR

-continued 1h-80
(SEQ ID NO: 156)
DIQMTQSPSSLSASVGDRVTITCRASQRIGSNLAWYQQKPGKAPKLLIYWASLLQSGVP

SRFSGSGSGTDFTLTISSLQPEDFATYYCQQTRSAPFTFGQGTKVEIKR 1h-80-1
(SEQ ID NO: 157)
DIQMTQSPSSLSASVGDRVTITCRASQRIGSNLAWYQQKPGRAPKLLIYWASLLQSGVP

SRFSGSGSGTDFTLIISSLQPEDFATYYCQQTRSAPFAFGQGTKVEIKR 1h-80-10
(SEQ ID NO: 158)
DLQMTQSPSSLSASVGDSVTITCRASQRIGSNLAWYQQKPGKAPKLLIYWASLLQSGVP

SRFSGSGSGTDFTLTISSLQPEDFATYYCQQTRSAPFTFGQGTKVEIKR 1h-80-11
(SEQ ID NO: 159)
DFQMTQSPSSLSASVGDRVTITCRAGQRIGSNLAWYQQKPGKAPKLLIYWASLLQSGVP

SRFSGSGSGTDFTLTISSLQPEDFATYYCQQTRSAPFTFGQGTKVEIKR 1h-80-12
(SEQ ID NO: 160)
DIQMTQSPSSLSASVGDRVTITCRASQRIGSNLAWYQQKPGKAPKLLVYWASLLQSGVP

SRFSGSGSGTDFTLTISSLQPEDFATYYCQQTRSAPFTFGQGTKVEIKR 1h-80-2
(SEQ ID NO: 161)
DIQMTQSPSSLSASVGDRVTITCRASQRIGSNLAWYQQKPGKAPKLLIYWASLLQSGVP

SRFSGSGSETDFTLTISSLQPEDFATYYCQQTRSAPFAFGQGTKVEIKR 1h-80-3
(SEQ ID NO: 162)
DIQMTQSPSSLSESIGDRVTITCRASQRIGSNLAWYQQKPGKAPKLLIYWASLLQNGVP

SRFSGSGSGTDFTLTISSLQPEDFATYYCQQTRSAPFTFGQGTKVEIKR 1h-80-4
(SEQ ID NO: 163)
DIQMIQSPSSLSASVGERVTIICQASQRIGSNLAWYQQKPGKAPKLLIYWASLLQSGVP

SRFSGSGSGSDFTLTISSLQPEDFATYYCQQTRSAPFTFGQGTKVEIKR 1h-80-5
(SEQ ID NO: 164)
DIQMTQSPSSLSASVGDRVTITCRASQRIGSNLAWYQQKPGKAPKLLIYWASLLQSGVP

SRFSGSGSGTDFTLTINSLQPEDFATYYCQQTRSAPFTFGQGTKVEIKR 1h-80-6
(SEQ ID NO: 165)
DIQMTQSPSSLSASVGDRVTITCRASQGIGSNLAWYQQKPGKAPKLLIYWASLLQSGVP

SRFSGSGSGTDFTLTISSLQPEDFATYYCQETRSAPFTFGQGTKVEIKR 1h-80-7
(SEQ ID NO: 166)
DIQMTQSPSSLSASVGDRVTITCRASQRIGSNLAWYQQKPGKAPKLLIYWASLLQSGVP

SRFSGSGSGSDFTLTISSLQPEDFATYYCQETRSAPFTFGQGTKVEIKR 1h-80-8
(SEQ ID NO: 167)
DLQMTQSPSSLSASVGDRVTITCRASQRIGSNLAWYQQKPGKAPKLLIYWASLLQSGVP

SRFSGSGSGTDFTLTISSLQPEDYATYYCQQTRSAPFTFGQGTKVEIKR 1h-80-9
(SEQ ID NO: 168)
DIQMTQSPSSLSASVGDRVTITCRASQRIGSNLAWYQQKPGKAPKLLIYWASLLQSGVP

SRFSGSGSATDFTLTISSLRPEDFATYYCQQTRSAPFAFGQGTKVEIKR

-continued 1h-81

(SEQ ID NO: 169)
DIQMTQSPSSLSASVGDRVTITCRASQEIDHGLAWYQQKPGKAPKLLIYWASRLQSGVP

SRFSGSGSGTDFTLTISSLQPEDFATYYCQQVVAAPFTFGQGTKVEIKR 1h-82

(SEQ ID NO: 170)
DIQMTQSPSSLSASVGDRVTITCRASQDIGLNLLWYQQKPGKAPTLLIYWSSMLQSGVP

SRFSGSGSGTDFTLTISSLQPEDFATYYCQQGRMRPFTFGQGTKVEIKR 1h-83

(SEQ ID NO: 171)
DIQMTQSPSSLSASVGDRVTITCRASQSIGHSLVWYQQKPGKAPKLLIYWASLLQSGVS

SRFSGSGSGTDFTLTISSLQPEDFATYYCQQSRAAPFTFGQGTKVEIKR 1h-84

(SEQ ID NO: 172)
DIQMTQSPSSLSASVGDRVTITCRASQSIGKGLMWYQQKPGKAPKLLIYWASMLQSGVP

SRFSGSGSGTDFTLTISSLQPEDFATYYCQQSLRTPFTFGQGTEVEIKR 1h-85

(SEQ ID NO: 173)
DIQMTQSPSSLSASVGDRVTITCRASQPIGASLLWYQQKPGKAPRLLIYWGSLLQSGVP

SRFSGSGSGTDFTLTISSLQPEDLATYYCQQSLRTPFTFGQGTKVEIKR 1h-86

(SEQ ID NO: 174)
DIQMTQSPSSLSASVGDRVTITCRASQDIGQSLVWYQQKPGKAPKLLIYWASMLQSGVP

SRFSGSGSGTDFTLTISSLQPEDFATYYCQQVMRRPFTFGQGTKVEIKR 1h-87

(SEQ ID NO: 175)
DIQMTQSPSSLSASVGDRVTITCRASQSIGKSLAWYQQKPGKAPKLLIYWVSLLQSGVP

SRFSGSGSGTDFTLTISSLQPEDFATYYCQQIVSRPFTFGQGTKVEIKR 1h-88

(SEQ ID NO: 176)
DIQMTQSPSSLSASVGDRVTITCRASQAISNGLLWYQQKPGKAPKLLIYWTSLLQSGVP

SRFSGSGSGTDFTLTISSLQPEDFATYYCQQVLRRPFTFGQGTKVEIKR 1h-89

(SEQ ID NO: 177)
DIQMTQSPSSLSASVGDRVTITCRASQDIANSLVWYQQKPGKAPKLLIYWVSILQSGVP

SRFSGSGSGTDFTLTISSLQPEDFATYYCQQTIAAPFTFGQGTKVEIKR 1h-90

(SEQ ID NO: 178)
DIQMTQSPSSLSASVGDRVTITCRASQTIGHGLVWYQQKPGKAPKLLIYWSSHLQSGVP

SRFSGSGSGTDFTLTISSLQPEDFATYYCQQTLRTPFTFGQGTKVEIKR 1h-107

(SEQ ID NO: 179)
DIQMTQSPSSLSASVGDRVTITCRASQYIGNALAWYQQKPGKAPKLLIYRGSYLQSGVP

SRFSGSGSRTDFTLTISSLQPEDFATYYCQQTALRPLTFGQGTKVEIKR 1h-108

(SEQ ID NO: 180)
DIQMTQSPSSLSASVGDRVTITCRASQYIGTALNWYQQKPGKAPKLLIYRRSHLQSGVP

SRFSGSGSGTDFTLTISSLQPEDFATYYCQQIALTPYTFGQGTKVEIKR 1h-108-1

(SEQ ID NO: 181)
DIQMTQSPSTLSASVGDRVTITCRASQYIGTALNWYQQKPGKAPKLLIYRGSHLQSGVP

SRFSGSGSGTDFTLTISSLQPEDFATYYCQQIALTPYTFGQGTKVEIKR 1h-108-10
(SEQ ID NO: 182)
DIQMTQSPSSLSASVGDRVTITCRASQYIGTALNWYQQKPGKAPKLLIYRGSHLQSGVP

SRFSGSGSGTDFTLTISSLQPEDFATYYCQQIALTPYTFGQGTKVEIKR 1h-108-11
(SEQ ID NO: 183)
DIQMTQSPSSLSASVGDRVTITCRASQYIGTALNWYQQKPGKAPKLLIYRGSHLLSGVP

SRFSGSGSGTDFTLTISSLQPEDLATYYCQQIALTPYTFGQGTKVEIKR 1h-108-12
(SEQ ID NO: 184)
DIQMTQSPSSLSASVGDRVTITCRASQYIGTALNWYQQKPGEAPKLLIYRRSHLQSGVP

SRFSGSGSETDFTLTISSLQPEDFVTYYCQQIALTPYTFGQGTKVEIKR 1h-108-2
(SEQ ID NO: 185)
DIQMTQSPSSLSASVGDRVTISCRASQYIGTALNWYQQKPGEAPKLLIYRRSHLQSGVP

SRFSGSGSGTDFTLTISSLQPEDFATYYCQQIALTPFTFGQGTKVEIKR 1h-108-3
(SEQ ID NO: 186)
DIQMTQSPTSLSASVGDRVIITCRASQYIGTALNWYQQKPGKAPKLLIYRGSHLQSGVP

SRFSGSGSGTDFTLTISSLQPEDFATYYCQQIALTPYTFGQGTKVEIKR 1h-108-4
(SEQ ID NO: 187)
DIQMTQSPSSLSASVGDRVTITCRASQYIGTALNWYQQKRGKAPELLIYRRSHLQSGVP

SRFSGSGYGTDFTLTISSLQPEDFATYYCQQIALTPYTFSQGTKVEIKR 1h-108-5
(SEQ ID NO: 188)
DIQITQSPSSLSASVGDRVTITCRASQYIGTALNWYQQKPGKAPELLIYRGSHLQSGVP

SRFSGSGSGTDFTLTISSLQPEDFVTYYCQQIALTPYTFGQGTKVEIKR 1h-108-6
(SEQ ID NO: 189)
DIQITQSPSSLSASVGDRVTFTCQASQYIGTALNWYQQKPGKAPKLLIYRGSHLQGGVP

SRFSGSGSGTDFTLTISSLQLEDFATYYCQQIALTPYTFGQGTKVEIKR 1h-108-7
(SEQ ID NO: 190)
DIQMTQSPSSLSASVGDRVTITCQASQYIGTALNWYQQKPGKAPKLLIYRGSHLQSGVP

SRFSGSGSGTDFTLTISSLQPEDFATYYCQQIALTPYTFGQGTKVEIER 1h-108-8
(SEQ ID NO: 191)
DIQMTQSPSSLSASVGDRVIITCRASQYIGTALNWYQQKPGNAPKLLIYRGSHLQSGVP

SRFSGSGSGTDFTLTISSLLPEDYATYYCQQIALTPYTFSQGTKVEIKR 1h-108-9
(SEQ ID NO: 192)
DIQMTQSPSSLSASVGDRVTITCRASQYIGTALNWYQQKPGKAPKLLIYRGSHLQSGVP

SRFSGSGSGTDFTLTISGLQPEDFATFYCQQIALTPYTFGQGTKVEIKR 1h-109
(SEQ ID NO: 193)
DIQMTQSPSSLSASVGDRVTITCRASQDIGASLLWYQQKPGKAPKLLIYFSSMLQSGVP

SRFSGSGSGTDFTLTISSLQPEDFATYYCQQSGMRPFTFGQGTKVEIKR 1h-110
(SEQ ID NO: 194)
DIQMTQSPSSLSASVGDRVTITCRASRDIGHMLNWYQQKPGKAPKLLIWFGSVLQSGVP

SRFSGSGSGTDFTLTISSLQPEDFATYYCVQGRLRPPTFGQGTKVEIKR

-continued 1h-111
(SEQ ID NO: 195)
DIQMTQSPSSLSASVGDRVTITCRASRSIGHQLVWYQQKPGKAPKLLIAWSSVLQSGVP

SRFSGSGSGTDFTLTISSLQPEDFATYYCRQDLSLPFTFGQGTKVEIKR 1h-116
(SEQ ID NO: 196)
DIQMTQSPSSLSASVGDRVTITCRASQSIYPFLEWYQQKPGKAPRLLIYFTSRLQSGVP

SRFSGSGSGTDFTLTISSLQPEDFATYYCQQNATNPATFGQGTKVEIKR 1h-200
(SEQ ID NO: 197)
DIQMTQSPSSLSASVGDRVTITCRASRDIALDLLWYQQKPGKAPKLLIKGWSGLQSGVP

SRFSGSGSGTDFTLTISSLQPEDFATYYCAQGWGRPVTFGQGTKVEIKC 1h-201
(SEQ ID NO: 198)
DIQMTQSPSSLSASVGDRVTITCRASQPIGSVLAWYQQKPGKAPKLLIYFSSILQSGVP

SRFSGSGSGTDFTLTISGLQPEDFATYYCQQALRSPFTFGQGTKVEIKC 1h-202
(SEQ ID NO: 199)
DIQMTQSPSSLSASVGDRVTITCRASQPIGASLLWYQQKPGKAPRLLIYWGSLLQSGVP

SRFSGSGSGTDFTLTISSLQPEDLATYYCQQSLRTPFTFGQGTKVEIKC 1h-203
(SEQ ID NO: 200)
DIQMTQSPSSLSASVGDRVTITCRASQPIGSVLAWYQQKPGKAPKLLIYFSSILQSGVP

SRFSGSGSGTDFTLTISSLQPEDFATYYCQQALRSPFTFGQGTKVEIKR 1h-203-1
(SEQ ID NO: 201)
DIQMTQSPSSLSASVGDRVTITCRASQPIGSVIAWYQQKPGKAPKLLIYFSSILQSGVP

SRFSGSGSGTDFTLTISSLQPEDFATYYCQQALRSPFTFGQGTKVEIKR 1h-203-2
(SEQ ID NO: 202)
DIQMTQSPSSLSASVGDRVTITCRASQPIGSVLAWYQQKPGKAPKLLIYFSSILQRGVP

SRFSGSGSGTDFTLTISSLQPEDFATYYCQQALRSPFTFGQGTKVEIKR 1h-203-3
(SEQ ID NO: 203)
DILMTQSPSSLSASVGDRVTITCRASQPIGSVLAWYQQKPGKAPKLLIYFSSILQRGVP

SRFSGSGSGTDFTLTISSLQPEDFATYYCQQALRSPFTFGQGTKVEIKR 1h-204
(SEQ ID NO: 204)
DIQMTQSPSSLSASVGDRVTITCRASQYIGTRLVWYQQKPGKAPKLLIYQSSLLQSGVP

SRFSGSGSGTDFTLTISSLQPEDSATYYCQQTALVPYTFGQGTKVEIKR 1h-205
(SEQ ID NO: 205)
DIQMTQSPSSLSASVGDRVTITCRASQPIGASLLWYQQKPGKAPRLLIYWGSLLQSGVP

SRFSGSGSGTDFTLTISSLQPEDFATYYCQQSLRTPFTFGQGTKVEIKR 1h-207
(SEQ ID NO: 206)
DIQMTQSPSSLSASVGDRVTITCRASQYIGTSLAWYQQKPGKAPKLLIYHSSGLQSGVP

SRFSGSGSGTDFTLTISSLQPEDFATYYCQQTALRPFTFGQGTKVEIKR 1h-208
(SEQ ID NO: 207)
DIQMTQSPSSLSASVGDRVTITCRASQYIGTALHWYQQKPGKAPKLLIYLSSNLQSGVP

SRFSGSGSGTDFTLTISSLQPEDFATYYCQQSALNPYTFGQGTKVEIKR

-continued 1h-209
(SEQ ID NO: 208)
DIQMTQSPSSLSASVGDRVTITCRASQDIGLNLLWYQQKPGKAPKLLIYWSSMLQSGVP

SRFSGSGSGTDFTLTISSLQPEDFATYYCQQGRMRPFTFGQGTKVEIKR 1h-217
(SEQ ID NO: 209)
DIQMTQSPSSLSASVGDRVTITCRASQSIGYSLAWYQQKPGKAPKLLIYWVSSLQSGVP

SRFSGSGSGTDFTLTISSLQPEDFATYYCQQTQRTPFTFGQGTKVEIKC 1h-218
(SEQ ID NO: 210)
DIQMTQSPSSLSASVGDRVTITCRASQYIGSALSWYQQKPGKAPKLLIYRASNLQSGVP

SRFSGSGSGTDFTLTISSLQPEDFATYYCQQLAIRPFTFGQGTKVEIKC 1h-219
(SEQ ID NO: 211)
DIQMTQSPSSLSASVGDRVTITCRASQYIGGALSWYQQKPGKAPKLLIYRASRLQSGVP

SRFSGSGSGTDFTLTISSLQPEDFATYYCQQVALVPYTFGQGTKVEIKC 1h-220
(SEQ ID NO: 212)
DIQMTQSPSSLSASVGDRVTITCRASQRIGSNLAWYQQKPGKAPKLLIYWASLLQSGVP

SRFSGSGSGTDFTLTISSLQPEDFATYYCQQTRSAPFTFGQGTKVEIKC 1h-221
(SEQ ID NO: 213)
DIQMTQSPSSLSASVGDRVTITCRASQPIGSVLAWYQQKPGKAPKLLIYFSSILQSGVP

SRFSGSGSGTDFTLTISSLQPEDFATYYCQQALRSPFTFGQGTKVEIKC 1h-223
(SEQ ID NO: 214)
DIQMTQSPSSLSASVGDRVTITCRASQPIGASLLWYQQKPGKAPRLLIYWGSLLQSGVP

SRFSGSGSGTDFTLTISSLQPEDFATYYCQQSLRTPFTFGQGTKVEIKC 1h-225
(SEQ ID NO: 215)
DIQMTQSPSSLSASVGDRVTITCRASQYIGTSLAWYQQKPGKAPKLLIYHSSGLQSGVP

SRFSGSGSGTDFTLTISSLQPEDFATYYCQQTALRPFTFGQGTKVEIKC 1h-227
(SEQ ID NO: 216)
DIQMTQSPSSLSASVGDRVTITCRASQDIGLNLLWYQQKPGKAPKLLIYWSSMLQSGVP

SRFSGSGSGTDFTLTISSLQPEDFATYYCQQGRMRPFTFGQGTKVEIKC 1h-228
(SEQ ID NO: 217)
DIQMTQSPSSLSASVGDRVTITCRASQPIGASLLWYQQKPGKAPKLLIYWGSLLQSGVP

SRFSGSGSGTDFTLTISSLQPEDLATYYCQQSLRTPFTFGQGTKVEIKC 1h-229
(SEQ ID NO: 218)
DIQMTQSPSSLSASVGDRVTITCRASQYIGTRLVWYQQKPGKAPKLLIYQSSLLQSGVP

SRFRGSGSGTDFTLTISSLQPEDFATYYCQQTALVPYTFGQGTKVEIKC 1h-231
(SEQ ID NO: 219)
DIQMTQSPSSLSASVGDRVTITCRASQSIGYSLAWYQQKPGKDPKLLIYWVSSLQSGVP

SRFSGSGSGTDFTLTISSLQPEDFATYYCQQTQRTPFTFGQGTKVEIKR 1h-232
(SEQ ID NO: 220)
DIQMTQSPSSLSASVGDRVTITCRASQPIGSVLAWYQQKPGKDPKLLIYFSSILQSGVP

SRFSGSGSGTDFTLTISGLQPEDFATYYCQQALRSPFTFGQGTKVEIKR

-continued 1h-233

(SEQ ID NO: 221)
DIQMTQSPSSLSASVGDRVTITCRASQYIGTRLVWYQQKPGKDPKLLIYQSSLLQSGVP

SRFRGSGSGTDFTLTISSLQPEDSATYYCQQTALVPYTFGQGTKVEIKR 1h-234

(SEQ ID NO: 222)
DIQMTQSPSSLSASVGDRVTITCRASQPIGASLLWYQQKPGKDPKLLIYWGSLLQSGVP

SRFSGSGSGTDFTLTISSLQPEDLATYYCQQSLRTPFTFGQGTKVEIKR 1h-235

(SEQ ID NO: 223)
DIQMTQSPSSLSASVGDRVTITCRASQTIGHGLVWYQQKPGKDPKLLIYWSSHLQSGVP

SRFSGSGSGTDFTLTISSLQPEDFATYYCQQTLRTPFTFGQGTKVEIKR 1h-236

(SEQ ID NO: 224)
DIQMTQSPSSLSASVGDRVTITCRASQYIGTALNWYQQKPGKDPKLLIYRRSHLQSGVP

SRFSGSGSGTDFTLTISSLQPEDFATYYCQQIALTPYTFGQGTKVEIKR 1h-237

(SEQ ID NO: 225)
DIQMTQSPSSLSASVGDRVTITCRASQHINASLGWYQQKPGKDPKLLIYWASQLQSGVP

SRFSGSGSGTDFTLTISSLQPEDFATYYCQQMVRTPFTFGQGTKVEIKR 1h-238

(SEQ ID NO: 226)
DIQMTQSPSSLSASVGDRVTITCRASQHINASLGWYQQKPGKAPKLLIYWASQLQSGVP

SRFSGSGSGTDFTLTISSLQPEDFATYYCQQMVRTPFTFGQGTKVEIKR 1h-239

(SEQ ID NO: 227)
DIQMTQSPSSLSASVGDRVTITCRASQSIYPFLEWYQQKPGKAPKLLIYFTSRLQSGVP

SRFSGSGSGTDFTLTISSLQPEDFATYYCQQNATNPATFGQGTKVEIKR 1h-239-8

(SEQ ID NO: 228)
DIQMTQSPSSLSASVGDRVTITCRASQSIYPFLEWYQQKPGKAPKLLIYFTSRLQSGVP

SRFSGSGSGTDFTLTISSLQPEDFATYYCLQNVTNPATFSQGTKVEIKR 1h-239-804

(SEQ ID NO: 229)
DIQMTQSPSSLSASVGDRVTITCRASQSIYPFLEWYQQKPGKAPKLLIYFTSRLQSGVP

SRFSGSGSGTDFTLTISSLQPEDFATYYCLQNVSMPATFSQGTKVEIKR 1h-239-807

(SEQ ID NO: 230)
DIQMTQSPSSLSASVGDRVTITCRASRAIWPFLEWYQQKPGKAPKLLIYFTSRLQSGVP

SRFSGSGSGTDFTLTISSLQPEDFATYYCLQNVTNPATFSQGTKVEIKR 1h-239-809

(SEQ ID NO: 231)
DIQMTQSPSSLSASVGDRVTITCRASRPIWPFLEWYQQKPGKAPKLLIYFTSRLQSGVP

SRFSGSGSGTDFTLTISSLQPEDFATYYCLQNVTNPATFSQGTKVEIKR 1h-239-815

(SEQ ID NO: 232)
DIQMTQSPSSLSASVGDRVTITCRASQPIWPFLEWYQQKPGKAPKLLIYFTSRLQSGVP

SRFSGSGSGTDFTLTISSLQPEDFATYYCLQNVTNPATFSQGTKVEIKR 1h-239-816

(SEQ ID NO: 233)
DIQMTQSPSSLSASVGDRVTITCRASRTIYPFLEWYQQKPGKAPKLLIYFTSRLQSGVP

SRFSGSGSGTDFTLTISSLQPEDFATYYCLQNVTNPATFSQGTKVEIKR

-continued 1h-239-817

(SEQ ID NO: 234)
DIQMTQSPSSLSASVGDRVTITCRASKPIYPFLEWYQQKPGKAPKLLIYFTSRLQSGVP

SRFSGSGSGTDFTLTISSLQPEDFATYYCLQNVTNPATFSQGTKVEIKR 1h-239-819

(SEQ ID NO: 235)
DIQMTQSPSSLSASVGDRVTITCRASQAIWPFLEWYQQKPGKAPKLLIYFTSRLQSGVP

SRFSGSGSGTDFTLTISSLQPEDFATYYCLQNVTNPATFSQGTKVEIKR 1h-239-824

(SEQ ID NO: 236)
DIQMTQSPSSLSASVGDRVTITCRASQSIYPFLEWYQQKPGKAPKLLIYFTSRLRQGVP

SRFSGSGSGTDFTLTISSLQPEDFATYYCLQNVTNPATFSQGTKVEIKR 1h-239-828

(SEQ ID NO: 237)
DIQMTQSPSSLSASVGDRVTITCRASQSIYPFLEWYQQKPGKAPKLLIYFTSRLREGVP

SRFSGSGSGTDFTLTISSLQPEDFATYYCLQNVTNPATFSQGTKVEIKR 1h-239-829

(SEQ ID NO: 238)
DIQMTQSPSSLSASVGDRVTITCRASQSIYPFLEWYQQKPGKAPKLLIYFSSRLASGVP

SRFSGSGSGTDFTLTISSLQPEDFATYYCLQNVTNPATFSQGTKVEIKR 1h-239-832

(SEQ ID NO: 239)
DIQMTQSPSSLSASVGDRVTITCRASQSIYPFLEWYQQKPGKAPKLLIYFTSYLREGVP

SRFSGSGSGTDFTLTISSLQPEDFATYYCLQNVTNPATFSQGTKVEIKR 1h-239-833

(SEQ ID NO: 240)
DIQMTQSPSSLSASVGDRVTITCRASQSIYPFLEWYQQKPGKAPKLLIYFTSRLRAGVP

SRFSGSGSGTDFTLTISSLQPEDFATYYCLQNVTNPATFSQGTKVEIKR 1h-239-837

(SEQ ID NO: 241)
DIQMTQSPSSLSASVGDRVTITCRASQSIYPFLEWYQQKPGKAPKLLIYFTSRLASGVP

SRFSGSGSGTDFTLTISSLQPEDFATYYCLQNVTNPATFSQGTKVEIKR 1h-239-838

(SEQ ID NO: 242)
DIQMTQSPSSLSASVGDRVTITCQASQSIYPFLEWYQQKPGKAPKLLIYFTSRLARGVP

SRFSGSGSGTDFTLTISSLQPEDFATYYCLQNVTNPATFSQGTRVEIKR 1h-239-840

(SEQ ID NO: 243)
DIQMTQSPSSLSASVGDRVTITCRASQSIYPFLEWYQQKPGKAPKLLIYFASRLASGVP

SRFSGSGSGTDFTLTISSLQPEDFATYYCLQNVTNPATFSQGTKVEIKR 1h-239-847

(SEQ ID NO: 244)
DIQMTQSPSSLSASVGDRVTITCRASQSIYPFLEWYQQKPGKAPKLLIYFTSRLAYGVP

SRFSGSGSGTDFTLTISSLQPEDFATYYCLQNVTNPATFSQGTKVEIRR 1h-239-849

(SEQ ID NO: 245)
DIQMTQSPSSLSASVGDRVTITCRASQSIYPFLEWYQQKPGKAPKLLIYFTSKLTRGVP

SRFSGSGSGADFTLTISNLQPEDFATYYCLQNVTNPATFSQGTKVEIKR 1h-239-850

(SEQ ID NO: 246)
DIQMTQSPSSLSASVGDRVTITCRASRPIWPFLEWYQQKPGKAPKLLIYFTSRLQSGVP

SRFSGSGSGTDFTLTISSLQPEDFATYYCLQNVSMPATFSQGTKVEIKR

-continued 1h-239-851
(SEQ ID NO: 247)
DIQMTQSPSSLSASVGDRVTITCRASRNIYPFLEWYQQKPGKAPKLLIYFTSRLQSGVP

SRFSGSGSGTDFTLTISSLQPEDFATYYCLQNVTNPATFSQGTKVEIKR 1h-239-856
(SEQ ID NO: 248)
DIQMTQSPSSLSASVGDRVTITCRASQSIYPFLEWYQQKPGKAPKLLIYFTSRLRHGVP

SRFSGSGSGTDFTLTISSLQPEDFATYYCLQNVTNPATFSQGTKVEIKR 1h-239-857
(SEQ ID NO: 249)
DIQMTQSPSSLSASVGDRVTITCRASQSIYPFLEWYQQKPGKAPKLLIYFTSRLAAGVP

SRFSGSGSGTDFTLTISSLQPEDFATYYCLQNVTNPAAFSQGTKVEIKR 1h-239-859
(SEQ ID NO: 250)
DIQMTQSPSSLSASVGDRVTITCRASQSIYPFLEWYQQKPGKAPKLLIYFSSMLASGVP

SRFSGSGSGTDFTLTISSLQPEDFATYYCLQNVTNPATFSQGTKVEIKR 1h-239-861
(SEQ ID NO: 251)
DIQMTQSPSSLSASVGDRVTITCRASRPIWPFLEWYQQKPGKAPKLLIYFTSRLPAGVP

SRFSGSGSGTDFTLTISSLQPEDFATYYCQQNVSMPATFSQGTKVEIKR 1h-239-862
(SEQ ID NO: 252)
DIQMTQSPSSLSASVGDRVTITCRASRAIWPFLEWYQQKPGKAPKLLIYFTSRLAYGVP

SRFSGSGSGTDFTLTISSLQPEDFATYYCQQNVSMPATFSQGTKVEIKR 1h-239-863
(SEQ ID NO: 253)
DIQMTQSPSSLSASVGDRVTITCRASPAIWPFLEWYQQKPGKAPKLLIYFTSRLRQGVP

SRFSGSGSGTDFTLTISSLQPEDFATYYCQQNVSMPATFSQGTKVEIKR 1h-239-864
(SEQ ID NO: 254)
DIQMTQSPSSLSASVGDRVTITCRASRAIWPFLEWYQQKPGKAPKLLIYFTSRLRAGVP

SRFSGSGSGTDFTLTISSLQPEDFATYYCQQNVSMPATFSQGTKVEIKR 1h-239-869
(SEQ ID NO: 255)
DIQMTQSPSSLSASVGDRVTITCRASQSIYPFLEWYQQKPGKAPKLLIYFTSRLQSGVP

SRFSGSGSGTDFTLTISSLQPEDFATYYCLQNVQMPATFSQGTKVEIKR 1h-239-870
(SEQ ID NO: 256)
DIQMTQSPSSLSASVGDRVTITCRASQSIYPFLEWYQQKPGKAPKLLIYFTSRLQSGVP

SRFSGSGSGTDFTLTISSLQPEDFATYYCLQNVMMPATFSQGTKVEIKR 1h-239-871
(SEQ ID NO: 257)
DIQMTQSPSSLSASVGDRVTITCRASQSIYPFLEWYQQKPGKAPKLLIYFTSRLQSGVP

SRFSGSGSGTDFTLTISSLQPEDFATYYCLQNVANPATFSQGTKVEIKR 1h-239-872
(SEQ ID NO: 258)
DIQMTQSPSSLSASVGDRVTITCRASRPIWPFLEWYQQKPGKAPKLLIYFTSRLRAGVP

SRFSGSGSGTDFTLTISSLQPEDFATYYCLQNVSMPATFSQGTKVEIKR 1h-239-873
(SEQ ID NO: 259)
DIQMTQSPSSLSASVGDRVTITCRASRAIWPFLEWYQQKPGKAPKLLIYFTSRLAYGVP

SRFSGSGSGTDFTLTISSLQPEDFATYYCLQNVSMPATFSQGTKVEIKR 1h-239-874
(SEQ ID NO: 260)
DIQMTQSPSSLSASVGDRVTITCRASRAIWPFLEWYQQKPGKAPKLLIYFTSRLRQGVP

SRFSGSGSGTDFTLTISSLQPEDFATYYCLQNVSMPATFSQGTKVEIKR 1h-239-875
(SEQ ID NO: 261)
DIQMTQSPSSLSASVGDRVTITCRASRAIWPFLEWYQQKPGKAPKLLIYFTSRLPAGVP

SRFSGSGSGTDFTLTISSLQPEDFATYYCLQNVSMPATFSQGTKVEIKR 1h-239-876
(SEQ ID NO: 262)
DIQMTQSPSSLSASVGDRVTITCRASQSIYPFLEWYQQKPGKAPKLLIYFTSRLRHGVP

SRFSGSGSGTDFTLTISSLQPEDFATYYCLQNVSMPATFSQGTKVEIKR 1h-239-877
(SEQ ID NO: 263)
DIQMTQSPSSLSASVGDRVTITCRASQSIYPFLEWYQQKPGKAPKLLIYFTSRLAAGVP

SRFSGSGSGTDFTLTISSLQPEDFATYYCLQNVSMPATFSQGTKVEIKR 1h-239-879
(SEQ ID NO: 264)
DIQMTQSPSSLSASVGDRVTITCRASRPIWPFLEWYQQKPGKAPKLLIYFTSRLRHGVP

SRFSGSGSGTDFTLTISSLQPEDFATYYCLQNVTNPATFSQGTKVEIKR 1h-239-880
(SEQ ID NO: 265)
DIQMTQSPSSLSASVGDRVTITCRASRPIWPFLEWYQQKPGKAPKLLIYFTSRLAAGVP

SRFSGSGSGTDFTLTISSLQPEDFATYYCLQNVTNPAAFSQGTKVEIKR 1h-239-881
(SEQ ID NO: 266)
DIQMTQSPSSLSASVGDRVTITCRASRPIWPFLEWYQQKPGKAPKLLIYFTSRLARGVP

SRFSGSGSGTDFTLTISSLQPEDFATYYCLQNVTNPATFSQGTRVEIKR 1h-239-882
(SEQ ID NO: 267)
DIQMTQSPSSLSASVGDRVTITCRASRPIWPFLEWYQQKPGKAPKLLIYFTSRLRHGVP

SRFSGSGSGTDFTLTISSLQPEDFATYYCLQNVSMPATFSQGTKVEIKR 1h-239-883
(SEQ ID NO: 268)
DIQMTQSPSSLSASVGDRVTITCRASRPIWPFLEWYQQKPGKAPKLLIYFTSRLAAGVP

SRFSGSGSGTDFTLTISSLQPEDFATYYCLQNVSMPATFSQGTKVEIKR 1h-239-885
(SEQ ID NO: 269)
DIQMTQSPSSLSASVGDRVTITCRASRPIWPFLEWYQQKPGKAPKLLIYFTSRLQSGVP

SRFSGSGSGTDFTLTISSLQPEDFATYYCLQNVQMPATFSQGTKVEIKR 1h-239-886
(SEQ ID NO: 270)
DIQMTQSPSSLSASVGDRVTITCRASRPIWPFLEWYQQKPGKAPKLLIYFTSRLQSGVP

SRFSGSGSGTDFTLTISSLQPEDFATYYCLQNVANPATFSQGTKVEIKR 1h-239-887
(SEQ ID NO: 472)
IQMTQSPSSLSASVGDRVTITCRASRPIWPFLEWYQQKPGKAPKLLIYFTSRLRAGVPS

RFSGSGSGTDFTLTISSLQPEDFATYYCLQNVANPATFSQGTKVEIKR 1h-239-888
(SEQ ID NO: 473)
DIQMTQSPSSLSASVGDRVTITCRASRAIWPFLEWYQQKPGKAPKLLIYFTSRLAYGVP

SRFSGSGSGTDFTLTISSLQPEDFATYYCLQNVANPATFSQGTKVEIKR

```
1h-239-889
                                                     (SEQ ID NO: 474)
DIQMTQSPSSLSASVGDRVTITCRASRAIWPFLEWYQQKPGKAPKLLIYFTSRLRQGVP

SRFSGSGSGTDFTLTISSLQPEDFATYYCLQNVANPATFSQGTKVEIKR 1h-239-890
                                                     (SEQ ID NO: 475)
DIQMTQSPSSLSASVGDRVTITCRASRPIWPFLEWYQQKPGKAPKLLIYFTSRLARGVP

SRFSGSGSGTDFTLTISSLQPEDFATYYCLQNVANPATFSQGTKVEIKR 1h-239-891
                                                     (SEQ ID NO: 476)
DIQMTQSPSSLSASVGDRVTITCRASRPIWPFLEWYQQKPGKAPKLLIYFTSRLRHGVP

SRFSGSGSGTDFTLTISSLQPEDFATYYCLQNVANPATFSQGTKVEIKR 1h-239-892
                                                     (SEQ ID NO: 477)
DIQMTQSPSSLSASVGDRVTITCRASRPIWPFLEWYQQKPGKAPKLLIYFTSRLAAGVP

SRFSGSGSGTDFTLTISSLQPEDFATYYCLQNVANPATFSQGTKVEIKR 1h-239-893
                                                     (SEQ ID NO: 478)
DIQMTQSPSSLSASVGDRVTITCRASRPIWPFLEWYQQKPGKAPKLLIYFTSRLRAGVP

SRFSGSGSGTDFTLTISSLQPEDFATYYCLQNVQMPATFSQGTKVEIKR 1h-239-894
                                                     (SEQ ID NO: 479)
DIQMTQSPSSLSASVGDRVTITCRASRAIWPFLEWYQQKPGKAPKLLIYFTSRLAYGVP

SRFSGSGSGTDFTLTISSLQPEDFATYYCLQNVQMPATFSQGTKVEIKR 1h-239-895
                                                     (SEQ ID NO: 480)
DIQMTQSPSSLSASVGDRVTITCRASRAIWPFLEWYQQKPGKAPKLLIYFTSRLRQGVP

SRFSGSGSGTDFTLTISSLQPEDFATYYCLQNVQMPATFSQGTKVEIKR 1h-239-896
                                                     (SEQ ID NO: 481)
DIQMTQSPSSLSASVGDRVTITCRASRPIWPFLEWYQQKPGKAPKLLIYFTSRLARGVP

SRFSGSGSGTDFTLTISSLQPEDFATYYCLQNVQMPATFSQGTKVEIKR 1h-239-897
                                                     (SEQ ID NO: 482)
DIQMTQSPSSLSASVGDRVTITCRASRPIWPFLEWYQQKPGKAPKLLIYFTSRLRHGVP

SRFSGSGSGTDFTLTISSLQPEDFATYYCLQNVQMPATFSQGTKVEIKR 1h-239-898
                                                     (SEQ ID NO: 483)
DIQMTQSPSSLSASVGDRVTITCRASRPIWPFLEWYQQKPGKAPKLLIYFTSRLAAGVP

SRFSGSGSGTDFTLTISSLQPEDFATYYCLQNVQMPATFSQGTKVEIKR 1h-239-9
                                                     (SEQ ID NO: 271)
DIQMTQSPSSLSASVGDRVTITCRASQSIYPFLEWYQQKPGKAPKLLIYFTSRLQSGVP

SRFSGSGSGTDFTLTISSLQPEDFATYYCLQNVTNPATFGQGTKVEIKR 1h-112
                                                     (SEQ ID NO: 397)
DIQMTQSPSSLSASVGDRVTITCRASQHINASLGWYQQKPGKAPRLLIYWASQLQSGVP

SRFSGSGSGTDFTLTISSLQPEDFATYYCQQMVRTPFTFGQGTKVEIKR 1h-239-89101
                                                     (SEQ ID NO: 532)
DIQMTQSPSSLSASVGDRVTITCRASRNIWPFLEWYQQKPGKAPKLLIYFTSRLRHGVP

SRFSGSGSGTDFTLTISSLQPEDFATYYCLQNVANPATFSQGTKVEIKR
```

1h-239-89102
(SEQ ID NO: 533)
DIQMTQSPSSLSASVGDRVTITCRASRPIWPFLEWYQQKPGKAPKLLIYFTSRLRHGVP

SRFSGSGSGTDFTLTISSLQPEDFATYYCLQNVANPATFAQGTKVEIKR 1h-239-89103
(SEQ ID NO: 534)
DIQMTQSPSSLSASVGDRVTITCRASRPIWPFLEWYQQKPGKAPKLLIYFTSRLRHGVP

SRFSGSGSGTDFTLTISSLQPEDFATYYCLQNVANPATFTQGTKVEIKR 1h-239-89104
(SEQ ID NO: 535)
DIQMTQSPSSLSASVGDRVTITCRASRPIWPFLEWYQQKPGKAPKLLIYFTSRLRHGVP

SRFSGSGSGTDFTLTISSLQPEDFATYYCLQNVANPATFPQGTKVEIKR 1h-239-891(Q3C)
(SEQ ID NO: 536)
DICMTQSPSSLSASVGDRVTITCRASRPIWPFLEWYQQKPGKAPKLLIYFTSRLRHGVP

SRFSGSGSGTDFTLTISSLQPEDFATYYCLQNVANPATFSQGTKVEIKR 1h-239-891(S9C)
(SEQ ID NO: 537)
DIQMTQSPCSLSASVGDRVTITCRASRPIWPFLEWYQQKPGKAPKLLIYFTSRLRHGVP

SRFSGSGSGTDFTLTISSLQPEDFATYYCLQNVANPATFSQGTKVEIKR 1h-239-891(R18C)
(SEQ ID NO: 538)
DIQMTQSPSSLSASVGDCVTITCRASRPIWPFLEWYQQKPGKAPKLLIYFTSRLRHGVP

SRFSGSGSGTDFTLTISSLQPEDFATYYCLQNVANPATFSQGTKVEIKR 1h-239-891(G41C)
(SEQ ID NO: 539)
DIQMTQSPSSLSASVGDRVTITCRASRPIWPFLEWYQQKPCKAPKLLIYFTSRLRHGVP

SRFSGSGSGTDFTLTISSLQPEDFATYYCLQNVANPATFSQGTKVEIKR 1h-239-891(K42C)
(SEQ ID NO: 540)
DIQMTQSPSSLSASVGDRVTITCRASRPIWPFLEWYQQKPGCAPKLLIYFTSRLRHGVP

SRFSGSGSGTDFTLTISSLQPEDFATYYCLQNVANPATFSQGTKVEIKR 1h-239-891(K45C)
(SEQ ID NO: 541)
DIQMTQSPSSLSASVGDRVTITCRASRPIWPFLEWYQQKPGKAPCLLIYFTSRLRHGVP

SRFSGSGSGTDFTLTISSLQPEDFATYYCLQNVANPATFSQGTKVEIKR 1h-239-891(S60C)
(SEQ ID NO: 542)
DIQMTQSPSSLSASVGDRVTITCRASRPIWPFLEWYQQKPGKAPKLLIYFTSRLRHGVP

CRFSGSGSGTDFTLTISSLQPEDFATYYCLQNVANPATFSQGTKVEIKR 1h-239-891(D70C)
(SEQ ID NO: 543)
DIQMTQSPSSLSASVGDRVTITCRASRPIWPFLEWYQQKPGKAPKLLIYFTSRLRHGVP

SRFSGSGSGTCFTLTISSLQPEDFATYYCLQNVANPATFSQGTKVEIKR 1h-239-891(T74C)
(SEQ ID NO: 544)
DIQMTQSPSSLSASVGDRVTITCRASRPIWPFLEWYQQKPGKAPKLLIYFTSRLRHGVP

SRFSGSGSGTDFTLCISSLQPEDFATYYCLQNVANPATFSQGTKVEIKR 1h-239-891(Q79C)
(SEQ ID NO: 545)
DIQMTQSPSSLSASVGDRVTITCRASRPIWPFLEWYQQKPGKAPKLLIYFTSRLRHGVP

SRFSGSGSGTDFTLTISSLCPEDFATYYCLQNVANPATFSQGTKVEIKR

-continued 1h-239-891(K103C)
(SEQ ID NO: 546)
DIQMTQSPSSLSASVGDRVTITCRASRPIWPFLEWYQQKPGKAPKLLIYFTSRLRHGVP

SRFSGSGSGTDFTLTISSLQPEDFATYYCLQNVANPATFSQGTCVEIKR 1h-239-89201
(SEQ ID NO: 547)
DIQMTQSPSSLSASVGDRVTITCRASRPIWPFLEWYQQKPGKAPKLLIYFTSRLAAGVP

SRFSGSGSGTDFTLTISSLQPEDFATYYCLQNVANPATFPQGTKVEIKR 1h-239-89202
(SEQ ID NO: 548)
DIQMTQSPSSLSASVGDRVTITCRASRPIWPFLEWYQQKPGKAPKLLIYFTSRLAAGVP

SRFSGSGSGTDFTLTISSLQPEDFATYYCLQNVANPATFFQGTKVEIKR 1h-239-89203
(SEQ ID NO: 549)
DIQMTQSPSSLSASVGDRVTITCRASRPIWPFLEWYQQKPGKAPKLLIYFTSRLAAGVP

SRFSGSGSGTDFTLTISSLQPEDFATYYCLQNVANPATFQQGTKVEIKR 1h-239-89204
(SEQ ID NO: 550)
DIQMTQSPSSLSASVGDRVTITCRASRPIWPFLEWYQQKPGKAPKLLIYFTSRLAAGVP

SRFSGSGSGTDFTLTISSLQPEDFATYYCLQNVANPATFVQGTKVEIKR 1h-239-89205
(SEQ ID NO: 551)
DIQMTQSPSSLSASVGDRVTITCRASRPIWPFLEWYQQKPGKAPKLLIYFTSRLAAGVP

SRFSGSGSGTDFTLTISSLQPEDFATYYCLQNVANPATFAQGTKVEIKR 1h-239-89206
(SEQ ID NO: 552)
DIQMTQSPSSLSASVGDRVTITCRASRPIWPFLEWYQQKPGKAPKLLIYFTSRLAAGVP

SRFSGSGSGTDFTLTISSLQPEDFATYYCLQNVANPATFIQGTKVEIKR 1h-239-89207
(SEQ ID NO: 553)
DIQMTQSPSSLSASVGDRVTITCRASRPIWPFLEWYQQKPGKAPKLLIYFTSRLAAGVP

SRFSGSGSGTDFTLTISSLQPEDFATYYCLQNVANPATFTQGTKVEIKR 1h-239-89208
(SEQ ID NO: 554)
DIQMTQSPSSLSASVGDRVTITCRASRPIWPFLEWYQQKPGKAPKLLIYFTSRLAAGVP

SRFSGSGSGTDFTLTISSLQPEDFATYYCLQNVANPATFMQGTKVEIKR 1h-239-89209
(SEQ ID NO: 555)
DIQMTQSPSSLSASVGDRVTITCRASRPIWPFLEWYQQKPGKAPKLLIYFTSRLAAGVP

SRFSGSGSGTDFTLTISSLQPEDFATYYCLQNVANPATFDQGTKVEIKR 1h-239-89210
(SEQ ID NO: 556)
DIQMTQSPSSLSASVGDRVTITCRASRPIWPFLEWYQQKPGKAPKLLIYFTSRLAAGVP

SRFSGSGSGTDFTLTISSLQPEDFATYYCLQNVANPATFYQGTKVEIKR 1h-239-89211
(SEQ ID NO: 557)
DIQMTQSPSSLSASVGDRVTITCRASRPIWPFLEWYQQKPGKAPKLLIYFTSRLAAGVP

SRFSGSGSGTDFTLTISSLQPEDFATYYCLQNLANPATFSQGTKVEIKR 1h-239-89212
(SEQ ID NO: 558)
DIQMTQSPSSLSASVGDRVTITCRASRPIWPFLEWYQQKPGKAPKLLIYFTSRLAAGVP

SRFSGSGSGTDFTLTISSLQPEDFATYYCLQNTANPATFSQGTKVEIKR 1h-239-89213

(SEQ ID NO: 559)
DIQMTQSPSSLSASVGDRVTITCRASRPIWPFLEWYQQKPGKAPKLLIYFTSRLAAGVP

SRFSGSGSGTDFTLTISSLQPEDFATYYCLQNAANPATFSQGTKVEIKR 1h-239-89214
(SEQ ID NO: 560)
DIQMTQSPSSLSASVGDRVTITCRASRPIWPFLEWYQQKPGKAPKLLIYFTSRLAAGVP

SRFSGSGSGTDFTLTISSLQPEDFATYYCIQNVANPATFSQGTKVEIKR 1h-239-89215
(SEQ ID NO: 561)
DIQMTQSPSSLSASVGDRVTITCRASRPIWPFLEWYQQKPGKAPKLLIYFTSRLAAGVP

SRFSGSGSGTDFTLTISSLQPEDFATYYCHQNVANPATFSQGTKVEIKR 1h-239-89216
(SEQ ID NO: 562)
DIQMTQSPSSLSASVGDRVTITCRASRPIWPFLEWYQQKPGKAPKLLIYFTSRLAAGVP

SRFSGSGSGTDFTLTISSLQPEDFATYYCFQNVANPATFSQGTKVEIKR 1h-239-89217
(SEQ ID NO: 563)
DIQMTQSPSSLSASVGDRVTITCRASRPIWPFLEWYQQKPGKAPKLLIYFTSRLAAGVP

SRFSGSGSGTDFTLTISSLQPEDFATYYCMQNVANPATFSQGTKVEIKR 1h-239-89227
(SEQ ID NO: 564)
DIQMTQSPSSLSASVGDRVTITCRASRPIWPFLEWYQQKPGKAPKLLIYFTSYLAAGVP

SRFSGSGSGTDFTLTISSLQPEDFATYYCLQNVANPATFSQGTKVEIKR 1h-239-89228
(SEQ ID NO: 565)
DIQMTQSPSSLSASVGDRVTITCRASRPIWPFLEWYQQKPGKAPKLLIYFTSQLAAGVP

SRFSGSGSGTDFTLTISSLQPEDFATYYCLQNVANPATFSQGTKVEIKR 1h-239-89229
(SEQ ID NO: 566)
DIQMTQSPSSLSASVGDRVTITCRASRPIWPFLEWYQQKPGKAPKLLIYFTSELAAGVP

SRFSGSGSGTDFTLTISSLQPEDFATYYCLQNVANPATFSQGTKVEIKR 1h-239-89230
(SEQ ID NO: 567)
DIQMTQSPSSLSASVGDRVTITCRASRPIWPFLEWYQQKPGKAPKLLIYFTSILAAGVP

SRFSGSGSGTDFTLTISSLQPEDFATYYCLQNVANPATFSQGTKVEIKR 1h-239-89231
(SEQ ID NO: 568)
DIQMTQSPSSLSASVGDRVTITCRASRPIWPFLEWYQQKPGKAPKLLIYFTSTLAAGVP

SRFSGSGSGTDFTLTISSLQPEDFATYYCLQNVANPATFSQGTKVEIKR 1h-239-89232
(SEQ ID NO: 569)
DIQMTQSPSSLSASVGDRVTITCRASRPIWPFLEWYQQKPGKAPKLLIYFTSSLAAGVP

SRFSGSGSGTDFTLTISSLQPEDFATYYCLQNVANPATFSQGTKVEIKR 1h-239-89233
(SEQ ID NO: 570)
DIQMTQSPSSLSASVGDRVTITCRASRPIWPFLEWYQQKPGKAPKLLIYFTSDLAAGVP

SRFSGSGSGTDFTLTISSLQPEDFATYYCLQNVANPATFSQGTKVEIKR 1h-239-89234
(SEQ ID NO: 571)
DIQMTQSPSSLSASVGDRVTITCRASRPIWPFLEWYQQKPGKAPKLLIYFTSMLAAGVP

SRFSGSGSGTDFTLTISSLQPEDFATYYCLQNVANPATFSQGTKVEIKR

-continued 1h-239-89218

(SEQ ID NO: 572)
DIQMTQSPSSLSASVGDRVTITCRASRWIWPFLEWYQQKPGKAPKLLIYFTSRLAAGVP

SRFSGSGSGTDFTLTISSLQPEDFATYYCLQNVANPATFSQGTKVEIKR 1h-239-89219

(SEQ ID NO: 573)
DIQMTQSPSSLSASVGDRVTITCRASRRIWPFLEWYQQKPGKAPKLLIYFTSRLAAGVP

SRFSGSGSGTDFTLTISSLQPEDFATYYCLQNVANPATFSQGTKVEIKR 1h-239-89220

(SEQ ID NO: 574)
DIQMTQSPSSLSASVGDRVTITCRASREIWPFLEWYQQKPGKAPKLLIYFTSRLAAGVP

SRFSGSGSGTDFTLTISSLQPEDFATYYCLQNVANPATFSQGTKVEIKR 1h-239-89221

(SEQ ID NO: 575)
DIQMTQSPSSLSASVGDRVTITCRASRTIWPFLEWYQQKPGKAPKLLIYFTSRLAAGVP

SRFSGSGSGTDFTLTISSLQPEDFATYYCLQNVANPATFSQGTKVEIKR 1h-239-89222

(SEQ ID NO: 576)
DIQMTQSPSSLSASVGDRVTITCRASRSIWPFLEWYQQKPGKAPKLLIYFTSRLAAGVP

SRFSGSGSGTDFTLTISSLQPEDFATYYCLQNVANPATFSQGTKVEIKR 1h-239-89223

(SEQ ID NO: 577)
DIQMTQSPSSLSASVGDRVTITCRASRAIWPFLEWYQQKPGKAPKLLIYFTSRLAAGVP

SRFSGSGSGTDFTLTISSLQPEDFATYYCLQNVANPATFSQGTKVEIKR 1h-239-89224

(SEQ ID NO: 578)
DIQMTQSPSSLSASVGDRVTITCRASRDIWPFLEWYQQKPGKAPKLLIYFTSRLAAGVP

SRFSGSGSGTDFTLTISSLQPEDFATYYCLQNVANPATFSQGTKVEIKR 1h-239-89225

(SEQ ID NO: 579)
DIQMTQSPSSLSASVGDRVTITCRASRFIWPFLEWYQQKPGKAPKLLIYFTSRLAAGVP

SRFSGSGSGTDFTLTISSLQPEDFATYYCLQNVANPATFSQGTKVEIKR 1h-239-89226

(SEQ ID NO: 580)
DIQMTQSPSSLSASVGDRVTITCRASRNIWPFLEWYQQKPGKAPKLLIYFTSRLAAGVP

SRFSGSGSGTDFTLTISSLQPEDFATYYCLQNVANPATFSQGTKVEIKR 1h-239-89235

(SEQ ID NO: 581)
DIQMTQSPSSLSASVGDRVTITCRASRKIWPFLEWYQQKPGKAPKLLIYFTSRLAAGVP

SRFSGSGSGTDFTLTISSLQPEDFATYYCLQNVANPATFSQGTKVEIKR 1h-239-89236

(SEQ ID NO: 582)
DIQMTQSPSSLSASVGDRVTITCRASRYIWPFLEWYQQKPGKAPKLLIYFTSRLAAGVP

SRFSGSGSGTDFTLTISSLQPEDFATYYCLQNVANPATFSQGTKVEIKR 1h-239-89237

(SEQ ID NO: 583)
DIQMTQSPSSLSASVGDRVTITCRASRPIWPFLEWYQQKPGKAPKLLIYFTSRLAAGVP

SRFSGSGSGTDFTLTISSLQPEDFATYYCLQNIANPATFSQGTKVEIKR 1h-239-89238

(SEQ ID NO: 584)
DIQMTQSPSSLSASVGDRVTITCRGSRTIWPFLEWYQQKPGKAPKLLIYFTSRLAAGVP

SRFSGSGSGTDFTLTISSLQPEDFATYYCLQNVANPATFPQGTKVEIKR

```
1h-239-89239
                                                  (SEQ ID NO: 585)
DIQMTQSPSSLSASVGDRVTITCRASRSIWPFLEWYQQKPGKAPKLLIYFTSTLAAGVP

SRFSGSGSGTDFTLTISSLQPEDFATYYCLQNVANPATFTQGTKVEIKR 1h-239-89240
                                                  (SEQ ID NO: 586)
DIQMTQSPSSLSASVGDRVTITCRASRNIWPFLEWYQQKPGKAPKLLIYFTSRLAAGVP

SRFSGSGSGTDFTLTISSLQPEDFATYYCLQNVANPATFTQGTKVEIKR 1h-239-89241
                                                  (SEQ ID NO: 587)
DIQMTQSPSSLSASVGDRVTITCRASRSIWPFLEWYQQKPGKAPKLLIYFTSRLAAGVP

SRFSGSGSGTDFTLTISSLQPEDFATYYCLQNVANPATFAQGTKVEIKR 1h-239-89242
                                                  (SEQ ID NO: 588)
DIQMTQSPSSLSASVGDRVTITCRASRSIWPFLEWYQQKPGKAPKLLIYFTSRLAAGVP

SRFSGSGSGTDFTLTISSLQPEDFATYYCLQNVANPATFPQGTKVEIKR 1h-239-89243
                                                  (SEQ ID NO: 589)
DIQMTQSPSSLSASVGDRVTITCRASRNIWPFLEWYQQKPGKAPKLLIYFTSRLAAGVP

SRFSGSGSGTDFTLTISSLQPEDFATYYCLQNVANPATFAQGTKVEIKR 1h-239-89244
                                                  (SEQ ID NO: 590)
DIQMTQSPSSLSASVGDRVTITCRASRNIWPFLEWYQQKPGKAPKLLIYFTSRLAAGVP

SRFSGSGSGTDFTLTISSLQPEDFATYYCLQNVANPATFPQGTKVEIKR 1h-239-89245
                                                  (SEQ ID NO: 591)
DIQMTQSPSSLSASVGDRVTITCRASRSIWPFLEWYQQKPGKAPKLLIYFTSTLAAGVP

SRFSGSGSGTDFTLTISSLQPEDFATYYCLQNVANPATFAQGTKVEIKR 1h-239-89246
                                                  (SEQ ID NO: 592)
DIQMTQSPSSLSASVGDRVTITCRASRTIWPFLEWYQQKPGKAPKLLIYFTSRLAAGVP

SRFSGSGSGTDFTLTISSLQPEDFATYYCLQNVANPATFAQGTKVEIKR 1h-239-89247
                                                  (SEQ ID NO: 593)
DIQMTQSPSSLSASVGDRVTITCRASRSIWPFLEWYQQKPGKAPKLLIYFTSRLAAGVP

SRFSGSGSGTDFTLTISSLQPEDFATYYCLQNVANPATFPQGTKVEIKR 1h-239-89248
                                                  (SEQ ID NO: 594)
DIQMTQSPSSLSASVGDRVTITCRASRSIWPFLEWYQQKPGKAPKLLIYFTSRLAAGVP

SRFSGSGSGTDFTLTISSLQPEDFATYYCLQNVANPATFTQGTKVEIKR 1h-239-89249
                                                  (SEQ ID NO: 595)
DIQMTQSPSSLSASVGDRVTITCRASRNIWPFLEWYQQKPGKAPKLLIYFTSTLAAGVP

SRFSGSGSGTDFTLTISSLQPEDFATYYCLQNVANPATFPQGTKVEIKR 1h-239-89250
                                                  (SEQ ID NO: 596)
DIQMTQSPSSLSASVGDRVTITCRASRSIWPFLEWYQQKPGKAPKLLIYFTSTLAAGVP

SRFSGSGSGTDFTLTISSLQPEDFATYYCLQNVANPATFPQGTKVEIKR 1h-239-850 CDR1
                                                  (SEQ ID NO: 484)
RASRPIWPFLE 1h-239-850 CDR2
                                                  (SEQ ID NO: 485)
FTSRLQS
```

-continued 1h-239-850 CDR3
(SEQ ID NO: 486)
LQNVSMPAT

1h-35 CDR1
(SEQ ID NO: 487)
RASQYIGSALS

1h-35 CDR2
(SEQ ID NO: 488)
RASNLQS

1h-35 CDR3
(SEQ ID NO: 489)
QQLAIRPFT

1h-36 CDR1
(SEQ ID NO: 490)
RASRDIALDLL

1h-36 CDR2
(SEQ ID NO: 491)
GWSGLQS

1h-36 CDR3
(SEQ ID NO: 492)
AQGWGRPVTFGQGTKVEIKR

1h-79 CDR1
(SEQ ID NO: 493)
RASQPIGHSLA

1h-79 CDR2
(SEQ ID NO: 494)
WASTLQS

1h-79 CDR3
(SEQ ID NO: 495)
QQMLRTPFT

1h-80 CDR1
(SEQ ID NO: 496)
RASQRIGSNLA

1h-80 CDR2
(SEQ ID NO: 497)
WASLLQS

1h-80 CDR3
(SEQ ID NO: 498)
QQTRSAPFT

1h-83 CDR1
(SEQ ID NO: 499)
RASQSIGHSLV

1h-83 CDR2
(SEQ ID NO: 500)
WASLLQS

1h-83 CDR3
(SEQ ID NO: 501)
QQSRAAPFTFGQGTKVEIKR

1h-108 CDR1
(SEQ ID NO: 502)
RASQYIGTALN

1h-108 CDR2
(SEQ ID NO: 503)
RRSHLQS

1h-108 CDR3
(SEQ ID NO: 504)
QQIALTPYT

1h-203 CDR1
(SEQ ID NO: 505)
RASQPIGSVLA

-continued 1h-203 CDR2
(SEQ ID NO: 506)
FSSILQS

1h-203 CDR3
(SEQ ID NO: 507)
QQALRSPFT

1h-207 CDR1
(SEQ ID NO: 508)
RASQYIGTSLA

1h-207 CDR2
(SEQ ID NO: 509)
HSSGLQS

1h-207 CDR3
(SEQ ID NO: 510)
QQTALRPFT

1h-238 CDR1
(SEQ ID NO: 511)
RASQHINASLG

1h-238 CDR2
(SEQ ID NO: 512)
WASQLQS

1h-238 CDR3
(SEQ ID NO: 513)
QQMVRTPFT

1h-239 CDR1
(SEQ ID NO: 514)
RASQSIYPFLE

1h-239 CDR2
(SEQ ID NO: 515)
FTSRLQS

1h-239 CDR3
(SEQ ID NO: 516)
QQNATNPAT

1h-239-891 CDR1
(SEQ ID NO: 636)
RASRPIWPFLE

1h-239-891 CDR2
(SEQ ID NO: 637)
FTSRLRH

1h-239-891 CDR3
(SEQ ID NO: 638)
LQNVANPAT

VH dAbs:
1h-99-237
(SEQ ID NO: 272)
EVQLLESGGGLVQPGGSLRLSCAASGFTFDSANMSWARQAPGKGLEWVS**WIEAPGVQTF
YADSVRGRFTISRDNSKNTLYLQMNSLRAEDTAVYYCARSPFGPLYGFDY**RGQGTLVTV
SS 1h-99-238
(SEQ ID NO: 273)
EVQLLESGGGLVQPGGSLRLSCAASGFTFDSANMSWARQAPGKGLEWVS**WIEASGVQTF
YADSVKGRFTISRDNSKNTLYLQMNSLRAEDTAVYYCAKSPFGPLYGFDY**RGQGTLVTV
SS 1h-37
(SEQ ID NO: 274)
EVQLLESGGGLVQPGGSLRLSCAASGFTFGTYKMVWVRQAPGKGLEWVS**SIGPGGLDTY
YADSVKGRFTISRDNSKNTLYLQMNSLRAEDTAVYYCAKSWMTLPITGFDY**RGQGTLVT
VSS

-continued 1h-93

(SEQ ID NO: 275)
EVQLLESGGGLVQPGGSLRLSCAASGFTFPLYEMAWVRQAPGKGLEWVSSIMSNGIRTY

YADSVKGRFTISRDNSKNTLYLQMNSLRAEDTAVYYCAKRKSSSSRTVFDYWGQGTLVT

VSS 1h-99

(SEQ ID NO: 276)
EVQLLESGGGLVQPGGSLRLSCAASGFTFDSANMTWVRQAPGKGLEWVSWIDDTGTQTY

YADSVKGRFTISRDNSKNTLYLQMNSLRAEDTAVYYCAKSPFGPLYGFDYWGQGTLVTV

SS 1h-4-1

(SEQ ID NO: 277)
EVQLLESGGGWVQPGGSLRLSCAASGFTFSRYHMAWVRQAPGKGLEWVSVIDSLGLQAY

YADSVKGRFTISRDNSKNTLYLQMNSMRAEDTAVYYCAEYSGAFDYWGQGTLVTVSS 1h-4-2

(SEQ ID NO: 278)
EVQLLESGGGLVQPGGSLHLSCAASGFTFTRYHMAWVRQAPGKGLEWVSVIDSLGLQTY

YADSVKGRFTISRDNSKNTLYLQMNSLRAEDTAVYYCAEYGGAFDYWGQGTLVTVSS 1h-4-3

(SEQ ID NO: 279)
EVQLLESGGGLVQPGGSLRLSCAASGFTFSRYHMAWVRQAPGKGLEWVSVIDSLGLQTY

YADSVKGRFTISRDNSKNTLYLQMNSLRAEDTAVYYCAEYSGAFDYWGQGTLVTVSS 1h-4-4

(SEQ ID NO: 280)
EVQLLESGGGLVQPGGSLRLSCAASGFTFSRYHMAWVRQAPGKGLEWVSVIDSLGLQTY

YADSVKGRFTISRDNSKNTLYLQMNSLRAEDTAVYYCAEYGGAFDYWGPGTLVTVSS 1h-29

(SEQ ID NO: 281)
EVQLLESGGGLVQPGGSLRLSCAASGFTFEDYDMNWVRQAPGKGLEWVSHIDRGGTLTY

YADSVKGRFTISRDNSKNTLYLQMNSLRAEDTAVYYCAKSTLMGFDYWGQGTLVTVSS 1h-30

(SEQ ID NO: 282)
EVQLLESGGGLVQPGGSLRLSCAASGFTFAHYHMGWVRQAPGKGLEWVSWIPADGLRTY

YADSVKGRFTISRDNSKNTLYLQMNSLRAEDTAVYYCAKYEGAFDYWGQGTLVTVSS 1h-37

(SEQ ID NO: 283)
EVQLLESGGGLVQPGGSLRLSCAASGFTFGTYKMVWVRQAPGKGLEWVSSIGPGGLDTY

YADSVKGRFTISRDNSKNTLYLQMNSLRAEDTAVYYCAKSWMTLPITGFDYRGQGTLVT

VSS 1h-40

(SEQ ID NO: 284)
EVQLLESGGGLVQPGGSLRLSCAASGFTFKTYTMRWVRQAPGKGLEWVSTINSSGTLTY

YADSVKGRFTISRDNSKNTLYLQMNSLRAEDTAVYYCAKSSSYTFDYWGQGTLVTVSS 1h-91

(SEQ ID NO: 285)
EVQLLESGGGLVQPGGSLRLSCAASGFTFWFYDMQWVRQAPGKGLEWVSSITHNGKTTY

YADSVKGRFTISRDNSKNTLYLQMNSLRAEDTAVYYCAKDGQLTFDYWGQGTLVTVSS 1h-92

(SEQ ID NO: 286)
EVQLLESGGGLVQPGGSLRLSCAASGFTFELYQMGWVRQAPGKGLEWVSTIMPSGNLTY

YADSVKGRFTISRDNSKNTLYLQMNSLRAEDTAVYYCAKMWSLNLGFHAAFDYWGQGTL

VTVSS 1h-93
(SEQ ID NO: 287)
EVQLLESGGGLVQPGGSLRLSCAASGFTFPLYEMAWVRQAPGKGLEWVSSIMSNGIRTY

YADSVKGRFTISRDNSKNTLYLQMNSLRAEDTAVYYCAKRKSSSSRTVFDYWGQGTLVT

VSS 1h-93-1
(SEQ ID NO: 288)
EVQLLESGGGLVQPGGSLRLSCAASGFTFPLYEMAWVRQAPGKGLEWVSSIMSNGTRTY

YADSVKGRFTISRDNSKNTLYLQMNSLRAEDTAVYYCAKRESSSSRTVFDYWGQGTLVT

VSS 1h-93-2
(SEQ ID NO: 289)
EVQLLESGGGLVQPGGSLRLSCAASGFTFPLYEMAWVRQAPGKGLEWVSSIMSNGIRTY

YADSVKGRFTISRDNSKNTLYLQMNSLRAEDTAVYYCAKRESSSSRTVFDYWGQGTLVT

VSS 1h-93-201
(SEQ ID NO: 290)
EVQLLESGGGLVQPGGSLRLSCAASGFTFSVSEMAWVRQAPGKGLEWVSSIMSNGIRTY

YADSVKGRFTISRDNSKNTLYLQMNSLRAEDTAVYYCARRESSSSRTVFDYWGQGTLVT

VSS 1h-93-204
(SEQ ID NO: 291)
EVQLLESGGGLVQPGGSLRLSCAASGFTFYTAEMAWVRQAPGKGLEWVSSIMSNGIRTY

YADSVKGRFTISRDNSKNTLYLQMNSLRAEDTAVYYCARRESSSSRTVFDYWGQGTLVT

VSS 1h-94
(SEQ ID NO: 292)
EVQLLESGGGLVQPGGSLRLSCAASGFTFPGYTMEWVRQAPGKGLEWVSSITPLGANTY

YADSVKGRFTISRDNSRNTLYLQMNSLRAEDTAVYYCAKDIRYTGTYNFDYWGQGTLVT

VSS 1h-95
(SEQ ID NO: 293)
EVQLLESGGGLVQPGGSLRLSCAASGFTFPTYAMGWVRQAPGKGLEWVSFIPGAGGVTY

YADSVKGRFTISRDNSKNTLYLQMNSLRAEDTAVYYCAKAVDGLANAFDYWGQGTLVTV

SS 1h-96
(SEQ ID NO: 294)
EVQLLESGGGLVQPGGSLRLSCAASGFTFSSYAMIWVRQAPGKGLEWVSEISPYGNHTY

YADSVKGRFTISRDNSKNTLYLQMNSLRAEDTAVYYCAKPDRRFDYWGQGTLVTVSS 1h-97
(SEQ ID NO: 295)
EVQLLESGGGLVQPGGSLRLSCAASGFTFHSYHMTWVRQAPGKGLEWVSWIDAHGFTTY

YADSVKGRFTISRDNSKNTLYLQMNSLRAEDTAVYYCAKSRGGPLSTFDYWGQGTLVTV

SS 1h-98
(SEQ ID NO: 296)
EVQLLESGGGLVQPGGSLRLSCAASGFTFDTETMHWVRQAPGKGLEWVSSIYVPGSYTY

YADSVKGRFTISRDNSKNTLYLQMNSLRAEDTAVYYCAKGRHSDVEFDYWGQGTLVTVSS

-continued 1h-99
(SEQ ID NO: 297)
EVQLLESGGGLVQPGGSLRLSCAASGFTFDSANMTWVRQAPGKGLEWVSWIDDTGTQTY

YADSVKGRFTISRDNSKNTLYLQMNSLRAEDTAVYYCAKSPFGPLYGFDYWGQGTLVTV

SS 1h-99-1
(SEQ ID NO: 298)
EVQLLESGGGLVQPGGSLRLSCAASGFTFDSANMTWVRQAPGKGLEWVSWIEDTGTQTF

YADSVRGRFTISRDNFKNTLYLQMNSLRAEDTAVYYCAKSPFGPLYGFDYRGQGTLVTV

SS 1h-99-2
(SEQ ID NO: 299)
EVQLLESGGGLVQPGGSLRLSCAASGFTFDSANMSWVRQAPGKGLEWVSWIEDTGTQTF

YADSVKGRFTISRDNSKNTLYLQMNSLRAEDTAVYYCAKSPFGPLYGFDYRGQGTLVTV

SS 1h-99-201
(SEQ ID NO: 300)
EVQLLESGGGLVQPGGSLRLSCAASGFTFHRWNMSWARQAPGKGLEWVSWIEDTGTQTF

YADSVKGRFTISRDNSKNTLYLQMNSLRAEDTAVYYCAKSPFGPLYGFDYRGQGTLVTV

SS 1h-99-202
(SEQ ID NO: 301)
EVQLLESGGGLVQPGGSLRLSCAASGFTFSRHNMSWVRQAPGKGLEWVSWIEDTGTQTF

YADSVKGRFTISRDNSKNTLYLQMNSLRAEDTAVYYCAKSPFGPLYGFDYRGQGTLVTV

SS 1h-99-203
(SEQ ID NO: 302)
EVQLLESGGGLVQPGGSLRLSCAASGFTFYKANMSWARQAPGKGLEWVSWIEDTGTQTF

YADSVKGRFTISRDNSKNTLYLQMNSLRAEDTAVYYCAKSPFGPLYGFDYRGQGTLVTV

SS 1h-99-204
(SEQ ID NO: 303)
EVQLLESGGGLVQPGGSLRLSCAASGFTFVRQNMSWVRQAPGKGLEWVSWIEDTGTQTF

YADSVKGRFTISRDNSKNTLYLQMNSLRAEDTAVYYCAKSPFGPLYGFDYRGQGTLVTV

SS 1h-99-205
(SEQ ID NO: 304)
EVQLLESGGGLVQPGGSLRLSCAASGFTFSRSNMSWVRQAPGKGLEWVSWIEDTGTQTF

YADSVKGRFTISRDNSKNTLYLQMSSLRAEDTAVYYCAKSPFGPLYGFDYRGQGTLVTV

SS 1h-99-206
(SEQ ID NO: 305)
EVQLLESGGGLVQPGGSLRLSCAASGFTFPLHNMSWVRQAPGKGLEWVSWIEDTGTQTF

YADSVKGRFTISRDNSKNTLYLQMNSLRAEDTAVYYCAKSPFGPLYGFDYRGQGTLVTV

SS 1h-99-207
(SEQ ID NO: 306)
EVQLLESGGGLVQPGGSLRLSCAASGFTFPASNMSWVRQAPGKGLEWVSWIEDTGTQTF

YADSVKGRFTISRDNSKNTLYLQMNSLRAEDTAVYYCAKSPFGPLYGFDYRGQGTLVTV

SS

-continued 1h-99-208
(SEQ ID NO: 307)
EVQLLESGGGLVQPGGSLRLSCAASGFTFESSNMSWVRQAPGKGLEWVSWIEDTGTQTF

YADSVKGRFTISRDNSKNTLYLQMNSLRAEDTAVYYCAKSPFGPLYGFDYRGQGTLVTV

SS 1h-99-209
(SEQ ID NO: 308)
EVQLLESGGGLVQPGGSLRLSCAASGFTFDKANMSWVRQAPGKGLEWVSWIEDTGTQTF

YADSVKGRFTISRDNSKNTLYLQMNSLRAEDTAVYYCAKSPFGPLYGFDYRGQGTLVTV

SS 1h-99-210
(SEQ ID NO: 309)
EVQLLESGGGLVQPGGSLRLSCAASGFTFYTSNMSWVRQAPGKGLEWVSWIEDTGTQTF

YADSVKGRFTISRDNSKNTLYLQMNSLRAEDTAVYYCAKSPFGPLYGFDYRGQGTLVTV

SS 1h-99-211
(SEQ ID NO: 310)
EVQLLESGGGLVQPGGSLRLSCAASGFTFASANMSWARQAPGKGLEWVSWIEDTGTQTF

YADSVKGRFTISRDNSKNTLYLQMNSLRAEDTAVYYCAKSPFGPLYGFDYRGQGTLVTV

SS 1h-99-2112
(SEQ ID NO: 311)
EVQLLESGGGLVQPGGSLRLSCAASGFTFKDKNMSWARQAPGKGLEWVSWIEAPGVQTF

YADSVRGRFTISRDNSKNTLYLQMNSLRAEDTAVYYCARSPFGPLYGFDYRGQGTLVTV

SS 1h-99-2113
(SEQ ID NO: 312)
EVQLLESGGGLVQPGGSLRLSCAASGFTFKDKNMSWARQAPGKGLEWVSWIEASGVQTF

YADSVKGRFTISRDNSKNTLYLQMNSLRAEDTAVYYCAKSPFGPLYGFDYRGQGTLVTV

SS 1h-99-2114
(SEQ ID NO: 313)
EVQLLESGGGLVQPGGSLRLSCAASGFTFKDKNMSWARQAPGKGLEWVSWIEAIGVQTF

YADSVKGRFTISRDNSKNTLYLQMNSLRAEDTAVYYCAKSPFGPLYGFDYRGQGTLVTV

SS 1h-99-2115
(SEQ ID NO: 314)
EVQLLESGGGLVQPGGSLRLSCAASGFTFKDKNMSWVRQAPGKGLEWVSWIEAPGVQTF

YADSVRGRFTISRDNSKNTLYLQMNSLRAEDTAVYYCARSPFGPLYGFDYRGQGTLVTV

SS 1h-99-2116
(SEQ ID NO: 315)
EVQLLESGGGLVQPGGSLRLSCAASGFTFKDKNMSWVRQAPGKGLEWVSWIEASGVQTF

YADSVKGRFTISRDNSKNTLYLQMNSLRAEDTAVYYCAKSPFGPLYGFDYRGQGTLVTV

SS 1h-99-212
(SEQ ID NO: 316)
EVQLLESGGGLVQPGGSLRLSCAASGFTFVKANMSWVRQAPGKGLEWVSWIEDTGTQTF

YADSVKGRFTISRDNSKNTLYLQMNSLRAEDTAVYYCAKSPFGPLYGFDYRGQGTLVTV

SS

-continued 1h-99-213

(SEQ ID NO: 317)
EVQLLESGGGLVQPGGSLRLSCAASGFTFQHSNMSWVRQAPGKGLEWVSWIEDTGTQTF

YADSVKGRFTISRDNSKNTLYLQMNSLRAEDTAVYYCAKSPFGPLYGFDYRGQGTLVTV

SS 1h-99-214

(SEQ ID NO: 640)
EVQLLESGGGLVQPGGSLRLSCAASGFTFMRANMSWVRQAPGKGLEWVSWIEDTGTQTF

YADSVKGRFTISRDNSKNTLYLQMNSLRAEDTAVYYCAKSPFGPLYGFDYRGQGTLVTV

SS 1h-99-215

(SEQ ID NO: 318)
EVQLLESGGGLVQPGGSLRLSCAASGFTFDEANMSWVRQAPGKGLEWVSWIEDTGTQTF

YADSVKGRFTISRDNSKNTLYLQMNSLRAEDTAVYYCAKSPFGPLYGFDYRGQGTLVTV

SS 1h-99-216

(SEQ ID NO: 319)
EVQLLESGGGLVQPGGSLRLSCAASGFTFTRANMSWVRQAPGKGLEWVSWIEDTGTQTF

YADSVKGRFTISRDNSKNTLYLQMNSLRAEDTAVYYCAKSPFGPLYGFDYRGQGTLVTV

SS 1h-99-217

(SEQ ID NO: 320)
EVQLLESGGGLVQPGGSLRLSCAASGFTFSRSNMSWGRQAPGKGLEWVSWIEDTGTQTF

YADSVKGRFTISRDNSKNTLYLQMNSLRAEDTAVYYCAKSPFGPLYGFDYRGQGTLVTV

SS 1h-99-218

(SEQ ID NO: 321)
EVQLLESGGGLVQPGGSLRLSCAASGFTFDKSNMSWARQAPGKGLEWVSWIEDTGTQTF

YADSVKGRFTISRDNSKNTLYLQMNSLRAEDTAVYYCAKSPFGPLYGFDYRGQGTLVTV

SS 1h-99-219

(SEQ ID NO: 322)
EVQLLESGGGLVQPGGSLRLSCAASGFTFKLSNMSWARQAPGKGLEWVSWIEDTGTQTF

YADSVKGRFTISRDNSKNTLYLQMNSLRAEDTAVYYCAKSPFGPLYGFDYRGQGTLVTV

SS 1h-99-220

(SEQ ID NO: 323)
EVQLLESGGGLVQPGGSLRLSCAASGFTFYRSNMSWVRQAPGKGLEWVSWIEDTGTQTF

YADSVKGRFTISRDNSKNTLYLQMNSLRAEDTAVYYCAKSPFGPLYGFDYRGQGTLVTV

SS 1h-99-221

(SEQ ID NO: 324)
EVQLLESGGGLVQPGGSLRLSCAASGFTFARSNMSWVRQAPGKGLEWVSWIEDTGTQTF

YADSVKGRFTISRDNSKNTLYLQMNSLRAEDTAVYYCAKSPFGPLYGFDYRGQGTLVTV

SS 1h-99-222

(SEQ ID NO: 325)
EVQLLESGGGLVQPGGSLRLSCAASGFTFQRSNMSWVRQAPGKGLEWVSWIEDTGTQTF

YADSVKGRFTISRDNSKNTLYLQMNSLRAEDTAVYYCAKSPFGPLYGFDYRGQGTLVTV

SS

-continued 1h-99-223
(SEQ ID NO: 326)
EVQLLESGGGLVQPGGSLRLSCAASGFTFSYANMSWVRQAPGKGLEWVSWIEDTGTQTF

YADSVKGRFTISRDNSKNTLYLQMNSLRAEDTAVYYCAKSPFGPLYGFDYRGQGTLVTV

SS 1h-99-224
(SEQ ID NO: 327)
EVQLLESGGGLVQPGGSLRLSCAASGFTFSHNNMSWVRQAPGKGLEWVSWIEDTGTQTF

YADSVKGRFTISRDNSKNTLYLQMNSLRAEDTAVYYCAKSPFGPLYGFDYRGQGTLVTV

SS 1h-99-225
(SEQ ID NO: 328)
EVQLLESGGGLVQPGGSLRLSCAASGFTFRLQNMSWVRQAPGKGLEWVSWIEDTGTQTF

YADSVKGRFTISRDNSKNTLYLQMNSLRAEDTAVYYCAKSPFGPLYGFDYRGQGTLVTV

SS 1h-99-226
(SEQ ID NO: 329)
EVQLLESGGGLVQPGGSLRLSCAASGFTFKSANMSWVRQAPGKGLEWVSWIEDTGTQTF

YADSVKGRFTISRDNSKNTLYLQMNSLRAEDTAVYYCAKSPFGPLYGFDYRGQGTLVTV

SS 1h-99-227
(SEQ ID NO: 330)
EVQLLESGGGLVQPGGSLRLSCAASGFTFNHANMSWVRQAPGKGLEWVSWIEDTGTQTF

YADSVKGRFTISRDNYKNTLYLQMNSLRAEDTAVYYCAKSPFGPLYGFDYRGQGTLVTV

SS 1h-99-228
(SEQ ID NO: 331)
EVQLLESGGGLVQPGGSLRLSCAASGFTFHRANMSWVRQAPGKGLEWVSWIEDTGTQTF

YADSVKGRFTISRDNSKNTLYLQMNSLRAEDTAVYYCAKSPFGPLYGSDYRGQGTLVTV

SS 1h-99-229
(SEQ ID NO: 332)
EVQLLESGGGLVQPGGSLRLSCAASGFTFARTNMSWARQAPGKGLEWVSWIEDTGTQTF

YADSVKGRFTISRDNSKNTLYLQMNSLRAEDTAVYYCAKSPFGPLYGFDYRGQGTLVTV

SS 1h-99-230
(SEQ ID NO: 333)
EVQLLESGGGLVQPGGSLRLSCAASGFTFDSANMSWVRQAPGKGLEWVSWIESIGVQTF

YADSVKGRFTISRDNSKNTLYLQMNSLRAEDTAVYYCAKSPFGPLYGFDYRGQGTLVTV

SS 1h-99-231
(SEQ ID NO: 334)
EVQLLESGGGLVQPGGSLRLSCAASGFTFDSANMSWVRQAPGKGLEWVSWIEASGTQTF

YADSVKGRFTISRDNSKNTLYLQMNSLRAEDTAVYYCAKSPFGPLYGFDYRGQGTLVTV

SS 1h-99-232
(SEQ ID NO: 335)
EVQLLESGGGLVQPGGSLRLSCAASGFTFDSANMSWARQAPGKGLEWVSWIEALGVQTF

YADSVKGRFTISRDNSKNTLYLQMNSLRAEDTAVYYCAKSPFGPLYGFDSRGQGTLVTV

SS

-continued 1h-99-233
(SEQ ID NO: 336)
EVQLLESGGGLVQPGGSLRLSCAASGFTFDSANMSWVRQAPGKGLEWVSWIEASGRQTF

YADSVKGRFTISRDNSKNTLYLQMNGLRAEDTAVYYCAKSPFGPLYGFDYRGQGTLVTV

SS 1h-99-234
(SEQ ID NO: 337)
EVQLLESGGGLVQPGGSLRLSCAASGFTFDSANMSWVRQAPGKGLEWVSWIEAAGPQTF

YADSVKGRFTISRDNSKDTLYLQMNSLRAEDTAVYYCAKSPFGPLYGFDYRGQGTLVTV

SS 1h-99-235
(SEQ ID NO: 338)
EVQLLESGGGLVQPGGSLRLSCAASGFTFDSANMSWVRQAPGKGLEWVSWIENGGGQTF

YADSVKGRFTISRDNSKNTLYLQMNSLRAEDTAVYYCAKSPFGPLYGFDYRGQGTLVTV

SS 1h-99-236
(SEQ ID NO: 339)
EVQLLESGGGLVQPGGSLRLSCAASGFTFDSANMSWVRQAPGKGLEWVSWIEAPGKQTF

YADSVKGRFTISRDNSKNTLYLQMNSLRAEDTAVYYCAKSPFGPLYGFDYRGRGTLVTV

SS 1h-99-237
(SEQ ID NO: 340)
EVQLLESGGGLVQPGGSLRLSCAASGFTFDSANMSWARQAPGKGLEWVSWIEAPGVQTF

YADSVRGRFTISRDNSKNTLYLQMNSLRAEDTAVYYCARSPFGPLYGFDYRGQGTLVTV

SS 1h-99-238
(SEQ ID NO: 341)
EVQLLESGGGLVQPGGSLRLSCAASGFTFDSANMSWARQAPGKGLEWVSWIEASGVQTF

YADSVKGRFTISRDNSKNTLYLQMNSLRAEDTAVYYCAKSPFGPLYGFDYRGQGTLVTV

SS 1h-99-241
(SEQ ID NO: 342)
EVQLLESGGGLVQPGGSLRLSCAASGFTFDSANMSWVRQAPGKGLEWVSWIENNGPQTF

YADSVKGRFTISRDDSKNTLYLQMNSLRAEDTAVYYCAKSPFGPLYGFDYRGQGTLVTV

SS 1h-99-243
(SEQ ID NO: 343)
EVQLLESGGGLVQPGGSLRLSCAASGFTFDSANMSWGRQAPGKGLEWVSWIEASGVQTF

YADSVKGRFTISRDNSKNTLYLQMNSLRAEDTAVYYCAKSPFGPLYGFDYRGQGTLVTV

SS 1h-99-244
(SEQ ID NO: 344)
EVQLLESGGGLVQPGGSLRLSCAASGFTFDSANMSWVRQAPGKGLEWVSWIESSGPQTF

YADSVKGRFTISRDNSKNTLYLQMNSLRAEDTAVYYCAKSPFGPLYGFDYRGQGTLVTV

SS 1h-99-245
(SEQ ID NO: 345)
EVQLLESGGGLVQPGGSLRLSCAASGFTFDSANMSWARQAPGKGLEWVSWIEASGFQTF

YADSVKGRFTISRDNSKNTLYLQMNSLRAEDTAVYYCAKSPFGPLYGFDYRGQGTLVTV

SS

-continued 1h-99-246
(SEQ ID NO: 346)
EVQLLESGGGLVQPGGSLRLSCAASGFTFDSANMSWARQAPGKGLEWVSWIEASGGQTF

YADSVKGRFTISRDNSKNTLYLQMNSLRAEDTAVYYCAKSPFGPLYGFDYRGQGTLVTV

SS 1h-99-247
(SEQ ID NO: 347)
EVQLLESGGGLVQPGGSLRLSCAASGFTFDSANMSWARQAPGKGLEWVSWIEDQGVQTF

YADSVKGRFTISRDNSKSTLYLQMNSLRAEDTAVYYCAKSPFGPLYGFDYRGQGTLVTV

SS 1h-99-248
(SEQ ID NO: 348)
EVQLLESGGGLVQPGGSLRLSCAASGFTFDSANMSWVRQAPGKGLEWVSWIEDIGIQTF

YADSVKGRFTISRDNSKNTLYLQMNSLRAEDTAVYYCAKSPFGPLYGFDYRGQGTLVTV

SS 1h-99-249
(SEQ ID NO: 349)
EVQLLESGGGLVQPGGSLRLSCAASGFTFDSANMSWVRQAPGKGLEWVSWIEDIGVQTF

YADSVKGRFTISRDNSKNTLYLQMNSLRAEDTAVYYCAKSPFGPLYGFDYRGQGTLVTV

SS 1h-99-250
(SEQ ID NO: 350)
EVQLLESGGGLVQPGGSLRLSCAASGFTFDSANMSWARQAPGKGLEWVSWIEATGGQTF

YADSVKGRFTISRDNSKNTLYLQMNSLRAEDTAVYYCAKSPFGPLYGFDYRGQGTLVTV

SS 1h-99-251
(SEQ ID NO: 351)
EVQLLESGGGLVQPGGSLRLSCAASGFTFDSANMSWARQAPGKGLEWVSWIEAEGGQTF

YADSVKGRFTISRDNSKNTLYLQMNSLRAEDTAVYYCAKSPFGPLYGFDYRGQGTLVTV

SS 1h-99-252
(SEQ ID NO: 352)
EVQLLESGGGLVQPGGSLRLSCAASGFTFDSANMSWVRQAPGKGLEWVSWIESSGYQTF

YADSVKGRFTISRDNSKNTLYLQMNSLRAEDTAVYYCAKSPFGPLYGFDYRGQGTLVTV

SS 1h-99-253
(SEQ ID NO: 353)
EVQLLESGGGLVQPGGSLRLSCAASGFTFDSANMSWVRQAPGKDLEWVSWIEDSGIQTF

YADSVKGRFTISRDNSRNTLYLQMNSLRAEDTAVYYCAKSPFGPLYGFDYRGQGTLVTV

SS 1h-99-254
(SEQ ID NO: 354)
EVQLLESGGGLVQPGGSLRLSCAASGFTFDSANMSWARQAPGKGLEWVSWIESSGGQTF

YADSVKGRFTISRDNSKNTLYLQMNSLRAEDTAVYYCAKSPFGPLYGFDYRGQGTLVTV

SS 1h-99-255
(SEQ ID NO: 355)
EVQLLESGGGLVQPGGSLRLSCAASGFTFDSANMSWVRQAPGKGLEWVSWIESRGPQTF

YADSVKGRFTISRDNSKNTLYLQMNSLRAEDTAVYYCAKSPFGPLYGFDYRGQGTLVTV

SS 1h-99-256

(SEQ ID NO: 356)
EVQLLESGGGLVQPGGSLRLSCAASGFTFDSANMSWVRQAPGKGLEWVSWIEAIGVQTF

YADSVKGRFTISRDNSKNTLYLQMNSLRAEDTAVYYCAKSPFGPLYGFDYRGQGTLVTV

SS 1h-99-257

(SEQ ID NO: 357)
EVQLLESGGGLVQPGGSLRLSCAASGFTFDSANMSWARQAPGKGLEWVSWIEDGGLQTF

YADSVKGRFTISRDNSKNTLYLQMNSLRAEDTAVYYCAKSPFGPLYGFDYRGQGTLVTV

SS 1h-99-258

(SEQ ID NO: 358)
EVQLLESGGGLVQPGGSLRLSCAASGFTFDSANMSWARQAPGKGLEWVSWIESHGGQTF

YADSVKGRFTISRDNSKNTLYLQMNSLRAEDTAVYYCAKSPFGPLYGFDYRGQGTLVTV

SS 1h-99-259

(SEQ ID NO: 359)
EVQLLESGGGLVQPGGSLRLSCAASGFTFDSANMSWARQAPGKGLEWVSWIEGSGQQTF

YADSVKGRFTISRDNSKNTLYLQMNSLRAEDTAVYYCAKSPFGPLYGFDYRGQGTLVTV

SS 1h-99-260

(SEQ ID NO: 360)
EVQLLESGGGLVQPGGSLRLSCAASGFTFDSANMSWARQAPGKGLEWVSWIEANGPQTF

YADSVKGRFTISRDNSKNTLYLQMNSLRAEDTAVYYCAKSPFGPLYGFDYRGQGTLVTV

SS 1h-99-261

(SEQ ID NO: 361)
EVQLLESGGGLVQPGGSLRLSCAASGFTFDSANMSWVRQAPGKGLEWVSWIEASGVQTF

YADSVKGRFTISRDNSKNTLYLQMNSLRAEDTAVYYCAKSPFGPLYGFDYRGQGTLVTV

SS 1h-99-263

(SEQ ID NO: 362)
EVQLLESGGGLVQPGGSLRLSCAASGFTFYKANMSWVRQAPGKGLEWVSWIEASGVQTF

YADSVKGRFTISRDNSKNTLYLQMNSLRAEDTAVYYCAKSPFGPLYGFDYRGQGTLVTV

SS 1h-99-264

(SEQ ID NO: 363)
EVQLLESGGGLVQPGGSLRLSCAASGFTFDKSNMSWVRQAPGKGLEWVSWIEAPGVQTF

YADSVRGRFTISRDNSKNTLYLQMNSLRAEDTAVYYCARSPFGPLYGFDYRGQGTLVTV

SS 1h-99-265

(SEQ ID NO: 364)
EVQLLESGGGLVQPGGSLRLSCAASGFTFDKSNMSWARQAPGKGLEWVSWIEASGVQTF

YADSVKGRFTISRDNSKNTLYLQMNSLRAEDTAVYYCAKSPFGPLYGFDYRGQGTLVTV

SS 1h-99-266

(SEQ ID NO: 365)
EVQLLESGGGLVQPGGSLRLSCAASGFTFYRSNMSWVRQAPGKGLEWVSWIEAPGVQTF

YADSVRGRFTISRDNSKNTLYLQMNSLRAEDTAVYYCARSPFGPLYGFDYRGQGTLVTV

SS

-continued 1h-99-267
(SEQ ID NO: 366)
EVQLLESGGGLVQPGGSLRLSCAASGFTFYRSNMSWVRQAPGKGLEWVSWIEASGVQTF

YADSVKGRFTISRDNSKNTLYLQMNSLRAEDTAVYYCAKSPFGPLYGFDYRGQGTLVTV

SS 1h-99-268
(SEQ ID NO: 367)
EVQLLESGGGLVQPGGSLRLSCAASGFTFKSANMSWVRQAPGKGLEWVSWIEAPGVQTF

YADSVRGRFTISRDNSKNTLYLQMNSLRAEDTAVYYCARSPFGPLYGFDYRGQGTLVTV

SS 1h-99-269
(SEQ ID NO: 368)
EVQLLESGGGLVQPGGSLRLSCAASGFTFKSANMSWVRQAPGKGLEWVSWIEASGVQTF

YADSVKGRFTISRDNSKNTLYLQMNSLRAEDTAVYYCAKSPFGPLYGFDYRGQGTLVTV

SS 1h-99-270
(SEQ ID NO: 369)
EVQLLESGGGLVQPGGSLRLSCAASGFTFYKANMSWARQAPGKGLEWVSWIEASGVQTF

YADSVKGRFTISRDNSKNTLYLQMNSLRAEDTAVYYCAKSPFGPLYGFDYRGQGTLVTV

SS 1h-99-275
(SEQ ID NO: 370)
EVQLLESGGGLVQPGGSLRLSCAASGFTFKDKNMSWARQAPGKGLEWVSWIEDTGTQTF

YADSVKGRFTISRDNSKNTLYLQMNSLRAEDTAVYYCARSPFGPLYGFDYRGQGTLVTV

SS 1h-99-276
(SEQ ID NO: 371)
EVQLLESGGGLVQPGGSLRLSCAASGFTFNRANMSWARQAPGKGLEWVSWIEDTGTQTF

YADSVKGRFTISRDNSKNTLYLQMNSLRAEDTAVYYCAKSPFGPLYGFDYRGQGTLVTV

SS 1h-99-277
(SEQ ID NO: 372)
EVQLLESGGGLVQPGGSLRLSCAASGFTFDSANMSWARQAPGKGLEWVSWIEAVGVQTF

YADSVKGRFTISRDNSKNTLYLQMNSLRAEDTAVYYCAKSPFGPLYGFDYRGQGTLVTV

SS 1h-99-278
(SEQ ID NO: 373)
EVQLLESGGGLVQPGGSLRLSCAASGFTFPHSNMSWARQAPGKGLEWVSWIEDTGTQTF

YADSVKGRFTISRDNSKNTLYLQMNSLRAEDTAVYYCAKSPFGPLYGFDYRGQGTLVTV

SS 1h-99-297
(SEQ ID NO: 374)
EVQLLESGGGLVQPGGSLRLSCAASGFTFDSANMSWARQAPGKGLEWVSWIEAIGVQTF

YADSVKGRFTISRDNSKNTLYLQMNSLRAEDTAVYYCAKSPFGPLYGFDYRGQGTLVTV

SS 1h-99-6
(SEQ ID NO: 375)
EVQLLESGGGLVQPGGSLRLSCAASGFTFDSANMTWVRQAPGKGLEWVSWIDDTGTQTF

YEDSVKGRFTISRDNSKNTLYLQMNSLRAEDTAVYYCAKSPFGPLYGFDYRGQGTLVTV

SS 1h-99-11

(SEQ ID NO: 376)
EVQLLESGGGLVQPGGSLRLSCAASGFTFDSANMTWVRQAPGKGLEWVSWIDDIGSQTF

YADSVKGRFTISRDNSKNTLYLQMNSLRAEDTAVYYCAKSPFGPLYGFDYRGQGTLVTV

SS 1h-99-13

(SEQ ID NO: 377)
EVQLWESGGGLVQPGGSLRLSCAASGFTFDSANMTWVRQAPGKDLEWVSWIEDTGTQTF

YADSVKGRFTISRDNSKNTLYLQMNSLRAEDTAVYYCAKSPFGPLYGFDYRGQGTLVTV

SS 1h-99-14

(SEQ ID NO: 378)
EVQLLESGGGLVQPGGSLRLSCAASGFTFDSANMSWVRQAPGKGLEWVSWIEDTGTQTF

YADSVKGRFTISRDNSKNTLYLQMNSLRAEDTAVYYCAKSPFGPLYGFDYWGQGTLVTV

SS 1h-99-15

(SEQ ID NO: 379)
EVQLLESGGGLVQPGGSLRLSCAASGFTFDSANMTWVRQAPGKGLEWVSWIDDIGSQTF

YADSVKGRFTISRDNSKNTLYLQMNSLRAEDTAVYYCAKSPFGPLYGFDYWGQGTLVTV

SS 1h-100

(SEQ ID NO: 380)
EVQLLESGGGLVQPGGSLRLSCAASGFTFESYWMSWVRQAPGKGLEWVSTIADTGGLTY

YADSVKGRFTISRDNSKNTLYLQMNSLRAEDTAVYYCAKVAYVLDDQPAFDYWGQGTLV

TVSS 1h-101

(SEQ ID NO: 381)
EVQLLESGGGLVQPGGSLRLSCAASGFTFGDVSMGWVRQAPGKGLEWVSGIDGPGSNTY

YADSVKGRFTISRDNSKNTLYLQMNSLRAEDTAVYYCAKNHAGSTRNVFDYWSQGTLVT

VSS 1h-102

(SEQ ID NO: 382)
EVQLLESGGGLVQPGGSLRLSCAASGFTFSDYSMSWVRQAPGKGLEWVSSIRPSGLSTY

YADSVKGRFTISRDNSKNTLYLQMNSLRAEDTAVYYCAKQRARRYQDRPRFDYWGQGTL

VTVSS 1h-103

(SEQ ID NO: 383)
EVQLLESGGGLVQPGGSLRLSCAAAGFTFDHTEMGWVRQAPGKGLEWVSAITSDGLNTY

YADSVKGRFTISRDNSKNTLYLQMNSLRAEDTAVYYCAKGQDRPPWSFDYWGQGTLVTV

SS 1h-104

(SEQ ID NO: 384)
EVQLLESGGGLVQPGGSLRLSCADSGLTFSSYAMSWVRQAPGKGLEWVSSISTDGMGTY

YADSVKGRFTISRDNSKNTLYLQMNSLRAEDTAVYYCAKYLSAPVLMAYDYWGQGTLVT

VSS 1h-105

(SEQ ID NO: 385)
EVQLLESGGGLVQPGGSLRLSCAASGFTFPPYTMGWVRQAPGKGLEWVSWISSSGRKTY

YADSVKGRFTISRDNSKNTLYLQMNSLRAEDTAVYYCAKFRKSSVLRSMFDYWGQGTLV

TVSS 1h-106
(SEQ ID NO: 386)
EVQLLESGGGLVQPGGSLRLSCAASGFTFSRYPMSWVRQAPGKGLEWVSTIGGLGKTTY

YADSVKGRFTISRDNSKNTLYLQMNSLRAEDTAVYYCAESNMYRSIKYPFAYWGQGTLV

TVSS 1h-113
(SEQ ID NO: 387)
EVQLLESGGGLVQPGGSLRLSCAASGFTFAKYGMGWVRQAPGKGLEWVSGINGSGIWTY

YADSVKGRFTISRDNSKNTLYLQMNSLRAEDTAVYYCAKGHVHSPPRGPFLFDYWGQGT

LVTVSS 1h-114
(SEQ ID NO: 388)
EVQLLESGGGLVQPGGSLRLSCAASGFTFASYSMAWVRQAPGKGLEWVSTIMPSGQRTY

YADSVKGRFTISRDNSKNTLYLQMNSLRAEDTAVYYCAKNQSHQRRGIFDYWGQGTLVT

VSS 1h-115
(SEQ ID NO: 389)
EVQLLESGGGLVQPGGSLRLSCAASGFTFSEYSMAWVRQAPGKGLEWVSHISRDGEFTY

YADSVKGRFTISRDNSKNTLYLQMNSLRAEDTAVYYCAKGNADLGWVQPHLFVYWGQGT

LVTVSS 1h-117
(SEQ ID NO: 390)
EVQLLESGGGLVQPGGSLRLSCAASGFTFWRYNMGWARQAPGKGLEWVSSISPTGSITY

YADSVKGRFTISRDNSKNTLYLQMNSLRAEDTAVYYCAKWIGLMSLHPADFDYWGQGTL

VTVSS 1h-118
(SEQ ID NO: 391)
EVQLLESGGGLVQPGGSLRLSCAASGFTFDTETMHWVRQAPGKGLEWVSSIYVPGSYTY

YADSVKGRFTISRDNSKNTLYLQMNSLRAEDTAVYYCAKGRHSDVEFDYWGQGTLVTVSS 1h-119
(SEQ ID NO: 392)
EVQLLESGGGLVQPGGSLRLSCAASGFTFTDRCMMWVRQAPGKGLEWVSSIQVEGNHTY

YADSVKGRFTISRDNSKNTLYLQMNSLRAEDTAVYYCAKCMTVGPGNSFDYWGQGTLVT

VSS 1h-212
(SEQ ID NO: 393)
EVQLLESGGGLVQPGGSLRLSCAASGFTFGTYKMVWVRQAPGKGLEWVSSIGPGGLDTY

YADSVKGRFTISRDNSKNTLYLQMNSLRAEDTAVYYCAKSWMTLPITGFDYWGQGTLVT

VSS 1h-212-1
(SEQ ID NO: 394)
EVQLLESGGGLVQPGGSLRLSCAASGITFGTYKMVWVRQAPGKGLEWVSSIGPGGLDTY

YADSVKGRFTISRDNSKNTLYLQMNSLRAEDTAVYYCAISWMTLPITGFDYWGQGTLVT

VSS 1h-213
(SEQ ID NO: 395)
EVQLLESGGGLVQPGGSLRLSCAASGFTFDSAAMTWVRQAPGKGLEWVSWIDDTGTQTY

YADSVKGRFTISRDNSKNTLYLQMNSLRAEDTAVYYCAKSPFGPLYGFDYWGQGTLVTV

SS 1h-230

(SEQ ID NO: 396)
EVQLLESGGGLVQPGGSLRLSCAASGFTFGTYKMVWVRQAPGKGLEWVSSIGPGGLDTY

YADSVKGRFTISRDNSKNTLYLQMNSLRAEDTAVYYCAKSWMTLPITGFDYWGQGTLVT

VSC 1h-99-262

(SEQ ID NO: 398)
EVQLLESGGGLVQPGGSLRLSCAASGFTFYKANMSWVRQAPGKGLEWVSWIEAPGVQTF

YADSVRGRFTISRDNSKNTLYLQMNSLRAEDTAVYYCARSPFGPLYGFDYRGQGTLVTV

SS 1h-99-23701

(SEQ ID NO: 597)
EVQLLESGGGLVQPGGSLRLSCAASGFTFDSANMSWARQAPGKGLEWVSWIEAPGVQTY

YADSVRGRFTISRDNSKNTLYLQMNSLRAEDTAVYYCARSPFGPLYGFDYRGQGTLVTV

SS 1h-99-23702

(SEQ ID NO: 598)
EVQLLESGGGLVQPGGSLRLSCAASGFTFDSANMSWARQAPGKGLEWVSWIEAPGVQTF

YADSVSGRFTISRDNSKNTLYLQMNSLRAEDTAVYYCARSPFGPLYGFDYRGQGTLVTV

SS 1h-99-23703

(SEQ ID NO: 599)
EVQLLESGGGLVQPGGSLRLSCAASGFTFDSANMSWARQAPGKGLEWVSWIEAPGVQTF

YADSVQGRFTISRDNSKNTLYLQMNSLRAEDTAVYYCARSPFGPLYGFDYRGQGTLVTV

SS 1h-99-23704

(SEQ ID NO: 600)
EVQLLESGGGLVQPGGSLRLSCAASGFTFDSANMSWARQAPGKGLEWVSWIEAPGVQTF

YADSVKGRFTISRDNSKNTLYLQMNSLRAEDTAVYYCARSPFGPLYGFDYRGQGTLVTV

SS 1h-99-23705

(SEQ ID NO: 601)
EVQLLESGGGLVQPGGSLRLSCAASGFTFDSANMSWARQAPGKGLEWVSWIEAPGVQTF

YADSVHGRFTISRDNSKNTLYLQMNSLRAEDTAVYYCARSPFGPLYGFDYRGQGTLVTV

SS 1h-99-23706

(SEQ ID NO: 602)
EVQLLESGGGLVQPGGSLRLSCAASGFTFDSANMSWARQAPGKGLEWVSWIEAPGVQTF

YADSVFGRFTISRDNSKNTLYLQMNSLRAEDTAVYYCARSPFGPLYGFDYRGQGTLVTV

SS 1h-99-23707

(SEQ ID NO: 603)
EVQLLESGGGLVQPGGSLRLSCAASGFTFDSANMSWARQAPGKGLEWVSWIEAPGVQTF

YADSVLGRFTISRDNSKNTLYLQMNSLRAEDTAVYYCARSPFGPLYGFDYRGQGTLVTV

SS 1h-99-23708

(SEQ ID NO: 604)
EVQLLESGGGLVQPGGSLRLSCAASGFTFDSANMSWARQAPGKGLEWVSWIEAPGVQTF

YADSVPGRFTISRDNSKNTLYLQMNSLRAEDTAVYYCARSPFGPLYGFDYRGQGTLVTV

SS 1h-99-23709
(SEQ ID NO: 605)
EVQLLESGGGLVQPGGSLRLSCAASGFTFDSANMSWARQAPGKGLEWVSWIEAPGVQTF

YADSVRGRFTISRDNSKNTLYLQMNSLRAEDTAVYYCARSPAGPLYGFDYRGQGTLVTV

SS 1h-99-23710
(SEQ ID NO: 606)
EVQLLESGGGLVQPGGSLRLSCAASGFTFDSANMSWARQAPGKGLEWVSWIEAPGVQTF

YADSVRGRFTISRDNSKNTLYLQMNSLRAEDTAVYYCARSPWGPLYGFDYRGQGTLVTV

SS 1h-99-23711
(SEQ ID NO: 607)
EVQLLESGGGLVQPGGSLRLSCAASGFTFDSANMSWARQAPGKGLEWVSWIEAPGVQTF

YADSVRGRFTISRDNSKNTLYLQMNSLRAEDTAVYYCARSPEGPLYGFDYRGQGTLVTV

SS 1h-99-23712
(SEQ ID NO: 608)
EVQLLESGGGLVQPGGSLRLSCAASGFTFDSANMSWARQAPGKGLEWVSWIEAPGVQTF

YADSVRGRFTISRDNSKNTLYLQMNSLRAEDTAVYYCARSPSGPLYGFDYRGQGTLVTV

SS 1h-99-23713
(SEQ ID NO: 609)
EVQLLESGGGLVQPGGSLRLSCAASGFTFDSANMSWARQAPGKGLEWVSWIEAPGVQTF

YADSVRGRFTISRDNSKNTLYLQMNSLRAEDTAVYYCARSPGGPLYGFDYRGQGTLVTV

SS 1h-99-23714
(SEQ ID NO: 610)
EVQLLESGGGLVQPGGSLRLSCAASGFTFDSANMSWARQAPGKGLEWVSWIEAPGVQTF

YADSVRGRFTISRDNSKNTLYLQMNSLRAEDTAVYYCARSPKGPLYGFDYRGQGTLVTV

SS 1h-99-23715
(SEQ ID NO: 611)
EVQLLESGGGLVQPGGSLRLSCAASGFTFDSANMSWARQAPGKGLEWVSWIEAPGVQTF

YADSVRGRFTISRDNSKNTLYLQMNSLRAEDTAVYYCARSPFGTLYGFDYRGQGTLVTV

SS 1h-99-23716
(SEQ ID NO: 612)
EVQLLESGGGLVQPGGSLRLSCAASGFTFDSANMSWARQAPGKGLEWVSWIEAPGVQTF

YADSVRGRFTISRDNSKNTLYLQMNSLRAEDTAVYYCARSPFGALYGFDYRGQGTLVTV

SS 1h-99-23717
(SEQ ID NO: 613)
EVQLLESGGGLVQPGGSLRLSCAASGFTFDSANMSWARQAPGKGLEWVSWIEAPGVQTF

YADSVRGRFTISRDNSKNTLYLQMNSLRAEDTAVYYCARSPFGELYGFDYRGQGTLVTV

SS 1h-99-23718
(SEQ ID NO: 614)
EVQLLESGGGLVQPGGSLRLSCAASGFTFDSANMSWARQAPGKGLEWVSWIEAPGVQTF

YADSVRGRFTISRDNSKNTLYLQMNSLRAEDTAVYYCARSPFGRLYGFDYRGQGTLVTV

SS 1h-99-23719
(SEQ ID NO: 615)
EVQLLESGGGLVQPGGSLRLSCAASGFTFDSANMSWARQAPGKGLEWVSWIEAPGVQTF

YADSVRGRFTISRDNSKNTLYLQMNSLRAEDTAVYYCARSPFGFLYGFDYRGQGTLVTV

SS 1h-99-23720
(SEQ ID NO: 616)
EVQLLESGGGLVQPGGSLRLSCAASGFTFDSANMSWARQAPGKGLEWVSWIEAPGVQTF

YADSVRGRFTISRDNSKNTLYLQMNSLRAEDTAVYYCARSPFGPLYGFDYTGQGTLVTV

SS 1h-99-23721
(SEQ ID NO: 617)
EVQLLESGGGLVQPGGSLRLSCAASGFTFDSANMSWARQAPGKGLEWVSWIEAPGVQTF

YADSVRGRFTISRDNSKNTLYLQMNSLRAEDTAVYYCARSPFGPLYGFDYVGQGTLVTV

SS 1h-99-23722
(SEQ ID NO: 618)
EVQLLESGGGLVQPGGSLRLSCAASGFTFDSANMSWARQAPGKGLEWVSWIEAPGVQTF

YADSVRGRFTISRDNSKNTLYLQMNSLRAEDTAVYYCARSPFGPLYGFDYLGQGTLVTV

SS 1h-99-23723
(SEQ ID NO: 619)
EVQLLESGGGLVQPGGSLRLSCAASGFTFDSANMSWARQAPGKGLEWVSWIEAPGVQTF

YADSVRGRFTISRDNSKNTLYLQMNSLRAEDTAVYYCARSPFGPLYGFDYWGQGTLVTV

SS 1h-99-23724
(SEQ ID NO: 620)
EVQLLESGGGLVQPGGSLRLSCAASGFTFDSANMSWARQAPGKGLEWVSWIEAPGVQTF

YADSVRGRFTISRDNSKNTLYLQMNSLRAEDTAVYYCARSPFGPLYGFDYFGQGTLVTV

SS 1h-99-23725
(SEQ ID NO: 621)
EVQLLESGGGLVQPGGSLRLSCAASGFTFDSANMSWARQAPGKGLEWVSWIEAPGVQTF

YADSVRGRFTISRDNSKNTLYLQMNSLRAEDTAVYYCARSPFGPLYGFDYSGQGTLVTV

SS 1h-99-23726
(SEQ ID NO: 622)
EVQLLESGGGLVQPGGSLRLSCAASGFTFDSANMSWARQAPGKGLEWVSWIEAPGVQTF

YADSVRGRFTISRDNSKNTLYLQMNSLRAEDTAVYYCARSPFGPLYGFDYMGQGTLVTV

SS 1h-99-23727
(SEQ ID NO: 623)
EVQLLESGGGLVQPGGSLRLSCAASGFTFDSANMSWARQAPGKGLEWVSWIEAPGVQTF

YADSVRGRFTISRDNSKNTLYLQMNSLRAEDTAVYYCARSPFGPLYGFDYKGQGTLVTV

SS 1h-99-23728
(SEQ ID NO: 624)
EVQLLESGGGLVQPGGSLRLSCAASGFTFDSANMSWARQAPGKGLEWVSWIEAPGVQTF

YADSVRGRFTISRDNSKNTLYLQMNSLRAEDTAVYYCARSPFGPLYGFDYHGQGTLVTV

SS

-continued 1h-99-23729
(SEQ ID NO: 625)
EVQLLESGGGLVQPGGSLRLSCAASGFTFDSANMSWARQAPGKGLEWVSWIEAPGVQTF

YADSVRGRFTISRDNSKNTLYLQMNSLRAEDTAVYYCARSPFGPLYGFDYIGQGTLVTV

SS 1h-99-23730
(SEQ ID NO: 626)
EVQLLESGGGLVQPGGSLRLSCAASGFTFDSANMSWARQAPGKGLEWVSWIEAPGVQTF

YADSVRGRFTISRDNSKNTLYLQMNSLRAEDTAVYYCARSPLGPLYGFDYRGQGTLVTV

SS 1h-99-23731
(SEQ ID NO: 627)
EVQLLESGGGLVQPGGSLRLSCAASGFTFDSANMSWARQAPGKGLEWVSWIEAPGVQTF

YADSVRGRFTISRDNSKNTLYLQMNSLRAEDTAVYYCARSPRGPLYGFDYRGQGTLVTV

SS 1h-99-23732
(SEQ ID NO: 628)
EVQLLESGGGLVQPGGSLRLSCAASGFTFDSANMSWARQAPGKGLEWVSWIEAPGVQTF

YADSVRGRFTISRDNSKNTLYLQMNSLRAEDTAVYYCARSPFGPLYGFDYYGQGTLVTV

SS 1h-99-23733
(SEQ ID NO: 629)
EVQLLESGGGLVQPGGSLRLSCAASGFTFDSANMSWARQAPGKGLEWVSWIEAPGVQTF

YADSVRGRFTISRDNSKNTLYLQMNSLRAEDTAVYYCARSPFGPLYGFDYQGQGTLVTV

SS 1h-99-23734
(SEQ ID NO: 630)
EVQLLESGGGLVQPGGSLRLSCAASGFTFDSANMSWARQAPGKGLEWVSWIEAPGVQTF

YADSVRGRFTISRDNSKNTLYLQMNSLRAEDTAVYYCARSPRGPLYGFDYRGQGTLVTV

SS 1h-99-23735
(SEQ ID NO: 631)
EVQLLESGGGLVQPGGSLRLSCAASGFTFDSANMSWARQAPGKGLEWVSWIEAPGVQTF

YADSVRGRFTISRDNSKNTLYLQMNSLRAEDTAVYYCARLPMGILYGFDYRGQGTLVTV

SS 1h-99-23736
(SEQ ID NO: 632)
EVQLLESGGGLVQPGGSLRLSCAASGFTFDSANMSWARQAPGKGLEWVSWIEAPGVQTF

YADSVRGRFTISRDNSKNTLYLQMNSLRAEDTAVYYCARSPHGPLYGFDYRGQGTLVTV

SS 1h-99-23738
(SEQ ID NO: 633)
EVQLLESGGGLVQPGGSLRLSCAASGFTFDSANMSWARQAPGKGLEWVSWIEAPGVQTF

YADSVRGRFTISRDNSKNTLYLQMNSLRAEDTAVYYCARSPMGPLYGFDYRGQGTLVTV

SS 1h-99-23739
(SEQ ID NO: 634)
EVQLLESGGGLVQPGGSLRLSCAASGFTFDSANMSWARQAPGKGLEWVSWIEAPGVQTF

YADSVRGRFTISRDNSKNTLYLQMNSLRAEDTAVYYCARSPFGALYGFDYRGQGTLVTV

SS

```
1h-99-23737
                                                         (SEQ ID NO: 635)
EVQLLESGGGLVQPGGSLRLSCAASGFTFDSANMSWARQAPGKGLEWVSWIEAPGVQTF

YADSVRGRFTISRDNSKNTLYLQMNSLRAEDTAVYYCARSPKGPLYGFDYRGQGTLVTV

SS 1h-99-237 CDR1
                                                         (SEQ ID NO: 517)
SANMS 1h-99-237 CDR2
                                                         (SEQ ID NO: 518)
WIEAPGVQTFYADSVRG 1h-99-237 CDR3
                                                         (SEQ ID NO: 519)
SPFGPLYGFDY 1h-99-238 CDR1
                                                         (SEQ ID NO: 520)
SANMS 1h-99-238 CDR2
                                                         (SEQ ID NO: 521)
WIEASGVQTFYADSVKG 1h-99-238 CDR3
                                                         (SEQ ID NO: 522)
SPFGPLYGFDY 1h-37 CDR1
                                                         (SEQ ID NO: 523)
TYKMV 1h-37 CDR2
                                                         (SEQ ID NO: 524)
SIGPGGLDTYYADSVKG 1h-37 CDR3
                                                         (SEQ ID NO: 525)
SWMTLPITGFDY 1h-93 CDR1
                                                         (SEQ ID NO: 526)
LYEMA 1h-93 CDR2
                                                         (SEQ ID NO: 527)
SIMSNGIRTYYADSVKG 1h-93 CDR3
                                                         (SEQ ID NO: 528)
RKSSSSRTVFDY 1h-99 CDR1
                                                         (SEQ ID NO: 529)
SANMT 1h-99 CDR2
                                                         (SEQ ID NO: 530)
WIDDTGTQTYYADSVKG 1h-99 CDR3
                                                         (SEQ ID NO: 531)
SPFGPLYGFDY
```

Example 5

Additional Assays for dAb Activity

The following additional biological assays were used to examine the effect of the dAbs on CD28 activity.

Mixed Lymphocyte Response Cytokine Assays

For MLR experiments measuring cytokines at various time points in response to MoDCs as stimulator cells, assays were performed by combining $1.5 \times 10^5$ T cells/well of a 96-well round-bottom plate with $1.5 \times 10^4$ allogeneic MoDCs in a total volume of 300 μL of 10% FCS-RPMI. Titrations of CD28 domain antibodies, abatacept or belatacept were added in triplicate to measure cytokine release at 24, 48, and 72 hours after initiation of the MLR. IL-2 and TNF-α were detected in supernatants using Duoset ELISA development kits (R&D Systems; Minneapolis, Minn.). IFNγ was measured using paired antibodies and recombinant cytokine from Pierce Biotechnology (Rockford, Ill.). All kits and Abs were used according to the manufacturer's recommendations. Assay plates were processed and read on a SpectraMax Plus spectrophotometer (Molecular Devices Corp., Sunnyvale, Calif.). Data was analyzed using Softmax software by comparison against a standard curve generated using recombinant cytokines at known concentrations.

IL-2 Reporter Assay ("Luciferase Assay")

Jurkat-CA cells, transfected with the luciferase gene under the control of the IL-2 promoter were cultured in RPMI 1640 (Life Technologies, Inc. Gaithersburg, Md.), with 10% FCS (Summit Bio-technology, Ft. Collins, Colo.), 1% 1-glutamine, 1% sodium pyruvate, 25 mM HEPES and 0.4 mg/ml Geneticin (all from Life Technologies, Inc.). Raji cells (ATCC, Rockville, Md.) were cultured in RPMI 1640, with 10% FCS, 1% 1-glutamine. To initiate Jurkat cell activation, both Jurkat-CA cells and Raji cells were plated at $1.0 \times 10^6$ cells/ml each in a 96-well opaque plate (Perkin Elmer, Boston, Mass.). The combined cells are incubated with anti CD3 clone UCHT1 (0.1 µg/ml; BD Pharmingen, San Diego, Calif.) and dAbs at varying concentrations. After 16-20 hours, the plates were cooled to room temperature and Steady-Glo™ (Promega, Madison, Wis.) added to the plates. The plates were analyzed using a Topcount-NXT instrument (Perkin Elmer) within 30 minutes of addition of Steady-Glo.

Mixed Lymphocyte Reaction (MLR) Assays

PBMC were obtained by density-gradient separation (Lymphocyte Separation Media; Mediatech Inc., Herndon, Va.) of EDTA-treated whole blood from normal healthy donors. T cells were prepared from $E^+$ fractions of PBMC rosetted with SRBC (Colorado Serum Company; Denver, Colo.). Mature MoDC were prepared by adherence of monocytes from E fractions of PBMC from normal donors in 6-well tissue culture plates, followed by extensive gentle washing to remove non-adherent cells. Adherent cells were cultured for 7 days in RPMI containing either 10% FCS together with 100 ng/ml GM-CSF and 50 ng/ml IL-4, with one-half the medium changed every other day and replaced with fresh medium containing the same concentration of cytokines. On day 7, cells were matured with LPS (1 µg/ml) for 24 hours. These matured MoDC were then used as antigen-presenting cells in mixed lymphocyte reactions (MLR).

For MLR proliferation assays measuring titrations of CD28 domain antibodies, T cells were cultured at $1 \times 10^5$ cells/well in triplicate wells together with $2 \times 10^3$ of allogeneic MoDC as APC in 96-well round-bottom plates in a total volume of 200 µl of 10% FCS-RPMI. Domain antibodies were added at range of concentrations from 100 µg/ml to 10 ng/ml, dependent on relative potency. On day 5 after initiation of the MLR, cultures were pulsed with one µCi of $^3$[H]-thymidine (PerkinElmer, Boston, Mass.) for 6 hours, harvested on a Packard cell harvester (PerkinElmer), and subjected to liquid scintillation counting using a Packard TopCount-NXT instrument (PerkinElmer).

FIG. 3 illustrates the inhibition of T cell proliferation in vivo using dAb 1 m74-15-P40L. On day "−1", $30 \times 10^6$ cells/ml splenocytes obtained from DO11 T cell receptor mice were injected into BALB/c mice via the tail vein. On day zero, mice were intraperitoneally dosed with PBS, dAb or CTLA-4 Ig. Two hours after this intraperitoneal dosing, mice were injected in the footpad with 50 mg chicken ovalbumin emulsified 1:1 with Complete Freund's Adjuvant. On days one and two, were dosed intraperitoneally. On day three, draining popliteal lymph nodes were collected for staining with anti-CD4 APC and clonotypic antibody KJ-126 PE (FIG. 3). In FIG. 3, CD4 and KJ126 double positive cells represent antigen-specific T cells. Blood was collected from the animals for exposure, in order to determine the levels of dAb in the blood.

Figure 4A:
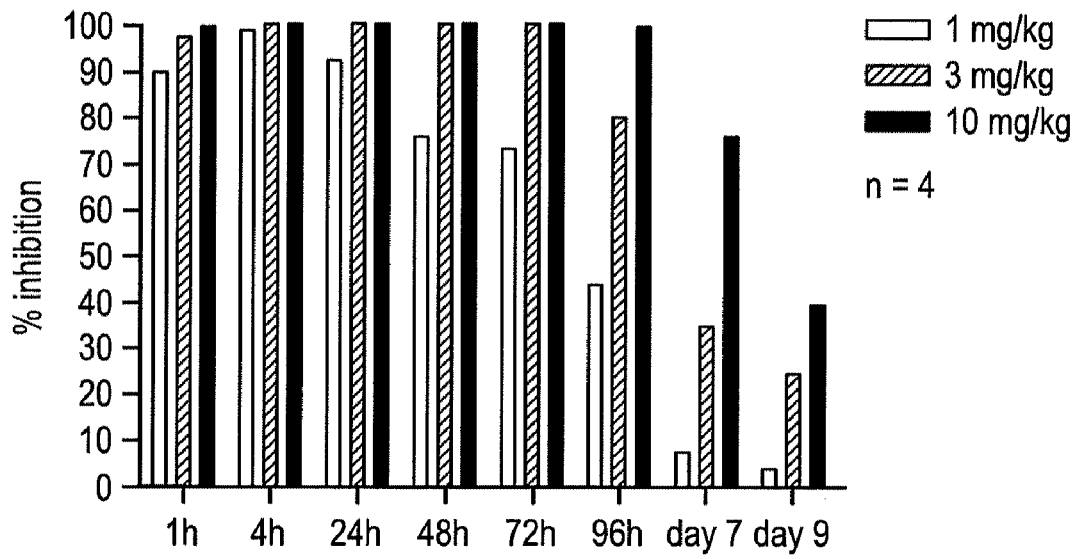
FIGS. 4A and 4B, is a series of images depicting the results of a nine-day receptor occupancy study, using dAb 1 m-74-15-40L.
Figure 4B:
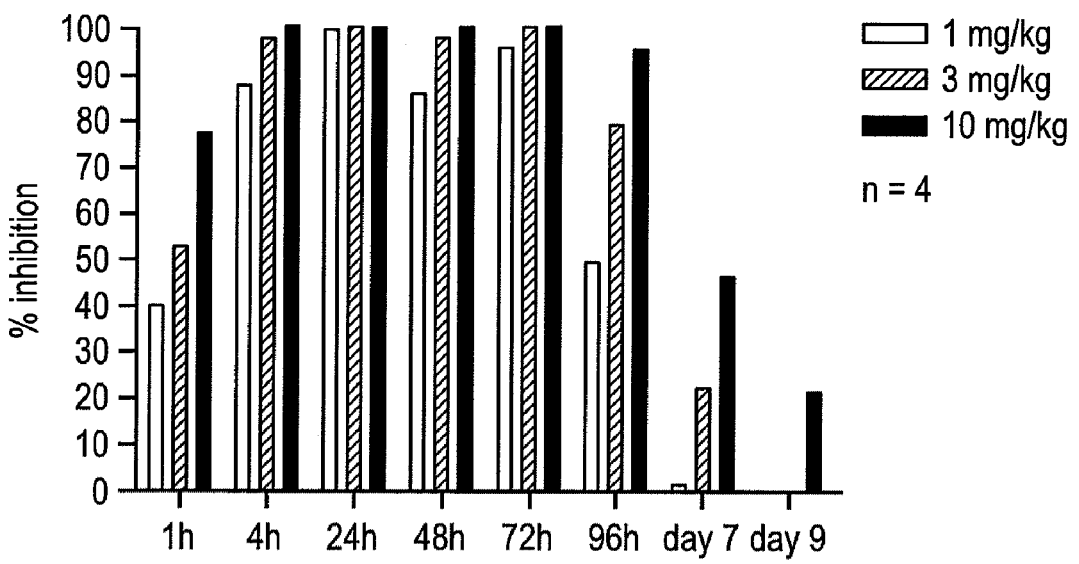

FIGS. 4A and 4B illustrate the results of a nine-day receptor occupancy (RO) study using dAb 1m74-15-P40L. Naïve BALB/c mice were injected intraperitoneally (FIG. 4A) or subcutaneously (FIG. 4B) with either PBS or 1m74-15 40L at 1-, 3-, or 10 mg/kg (n=4). Blood was collected from the animals at time points of 1, 4, 24, 48, 72, 96, 168, and 216 hours. For the dAb treated groups, 50 µl blood was used for staining with anti-CD4 APC and anti-CD28 PE and 50 µl blood was used for exposure. For the PBS groups, 50 µl blood was used for staining with anti-CD4 APC and anti-CD28 PE, and 50 µl blood was used for staining with anti-CD4 and anti-CD28 PE in the presence of excessive non-labeled anti-CD28 antibody to define non-specific binding. Mean fluorescence intensity (MFI) was used as a unit of measure of antibody binding. Percent receptor occupancy (% RO) was defined as "1−[CD28MFI(dAb)−CD28 MFI (non-specific)]/[CD28MFI(PBS)−CD28 MFI (non-specific)]".

Co-Agonist Assays

PBMC were obtained by density-gradient separation (Lymphocyte Separation Media; Mediatech Inc., Herndon, Va.) of EDTA-treated whole blood from normal healthy donors. T cells were prepared from $E^+$ fractions of PBMC rosetted with SRBC (Colorado Serum Company; Denver, Colo.). T cells were cultured at $1 \times 10^5$ cells/well in a total volume of 200 µl of 10% FCS-RPMI in triplicate wells of 96-well flat-bottom plates which had been previously coated with 20 µg/ml of anti-CD3 antibody (G19-4 mAb, Bristol-Myers Squibb) and washed prior to the assay. Domain antibodies were added at range of concentrations from 100 µg/ml to 0.3 µg/ml. Anti-CD28 (9.3 mAb, Bristol-Myers Squibb; Gibson et al. (1996) *Am Soc. Biochem. Mol. Bio.*, 271:7079-7083), 1.0 µg/ml, was used as a positive control. On day 3 after initiation of the assay, cultures were pulsed with one µCi of $^3$[H]-thymidine (PerkinElmer, Boston, Mass.) for 6 h, harvested on a Packard cell harvester (PerkinElmer), and subjected to liquid scintillation counting in a Packard TopCount NXT instrument (PerkinElmer).

Figure 2:
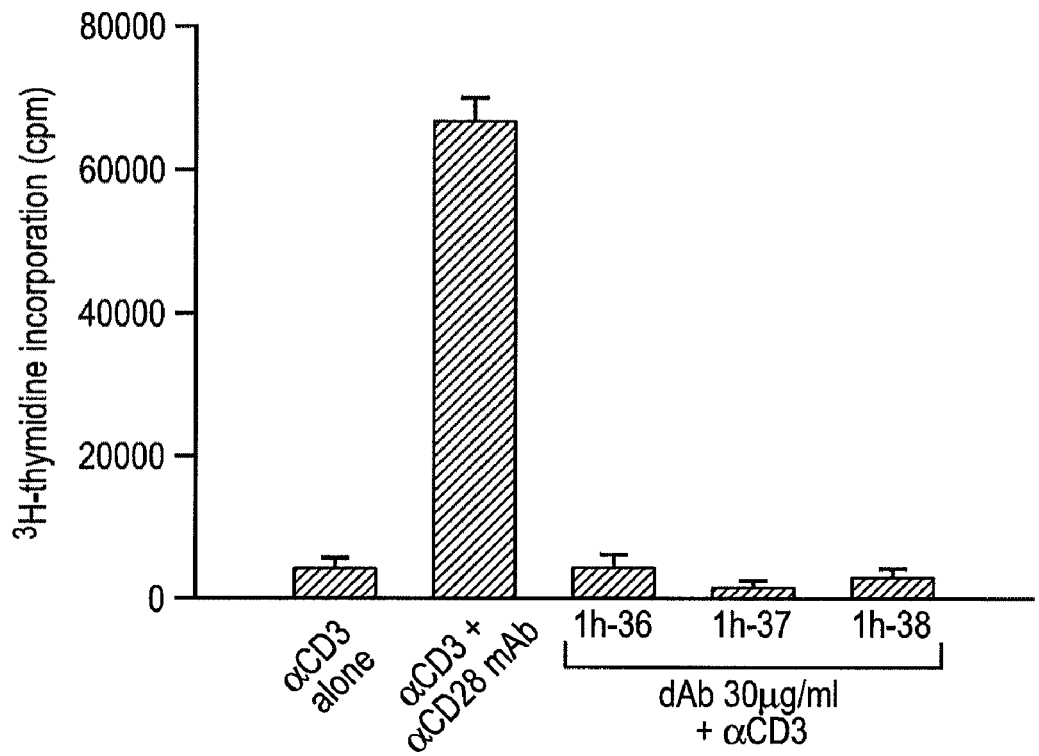
FIG. 2 is a graphic depicting that anti-human CD28 domain antibodies do not exhibit co-agonist activity when added to 96-well flat-bottom plates coated with anti-CD3 (G19-4, 10 µg/ml in PBS). Each dAb was added to the well at a final concentration of 30 µg/ml along with purified T cells. As a positive control, anti-CD28 (mAb 9.3), at a final concentration of 1 µg/ml, was added in place of the dAb.
Figure 3:
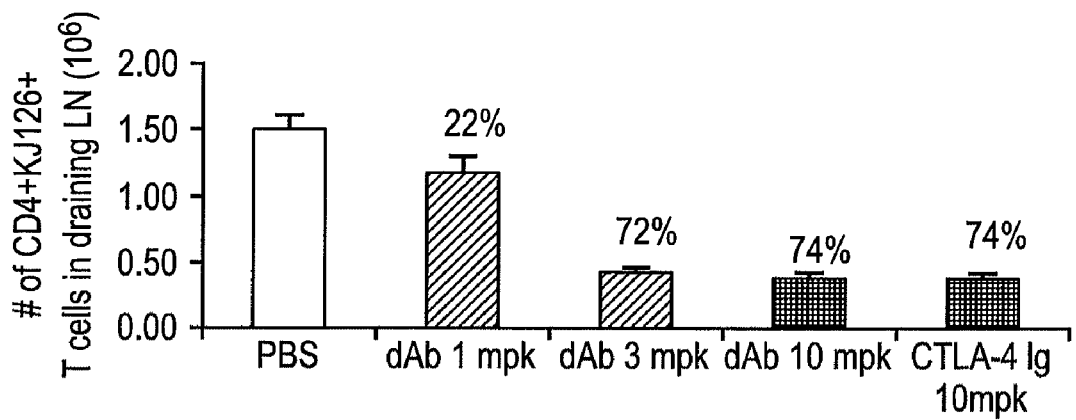
FIG. 3 is a graph depicting the in vivo inhibition of T cell proliferation by a domain antibody as set forth herein.

FIG. 2 illustrates that anti-human CD28 dAbs set forth herein do not exhibit co-agonist activity. Purified T cells ($1 \times 10^5$ cells/well) were added to 96-well flat-bottom plates coated with anti-CD3 (G19-4, 10 µg/ml in PBS). Each dAb, at a final concentration of 30 µg/ml, was added to cells in triplicate wells. As a positive control, anti-CD28 mAb (9.3) was added at a final concentration of 1 µg/ml in place of the dAb. Proliferation was measured by $^3$[H]-thymidine incorporation on day 3 (FIG. 2).

Agonist Assays

PBMC were obtained by density-gradient separation (Lymphocyte Separation Media; Mediatech Inc., Hemdon, Va.) of EDTA-treated whole blood from normal healthy donors. PBMC were cultured at $t \times 10^5$ cells/well in a total volume of 200 µl of 10% FCS-RPMI in triplicate wells of 96-well flat-bottom plates. The dAbs were added in a range of concentrations from 100 µg/ml to 0.3 µg/ml. Anti-CD3 (OKT3), 1 µg/ml in solution, was used as a positive control for maximal proliferation. Anti-CD28 (9.3, 10 µg/ml in solution), together with goat anti-mouse IgG (Jackson Immunoresearch, used at 50 µg/ml in solution) was also used as a comparator in some assays. On day 3 after initiation of the assay, cultures were pulsed with one µCi of $^3$[H]-thymidine (PerkinElmer, Boston, Mass.) for 6 hours, harvested on a Packard cell harvester (PerkinElmer), and subjected to liquid scintillation counting using a Packard TopCount NXT instrument (PerkinElmer).

Figure 1B:
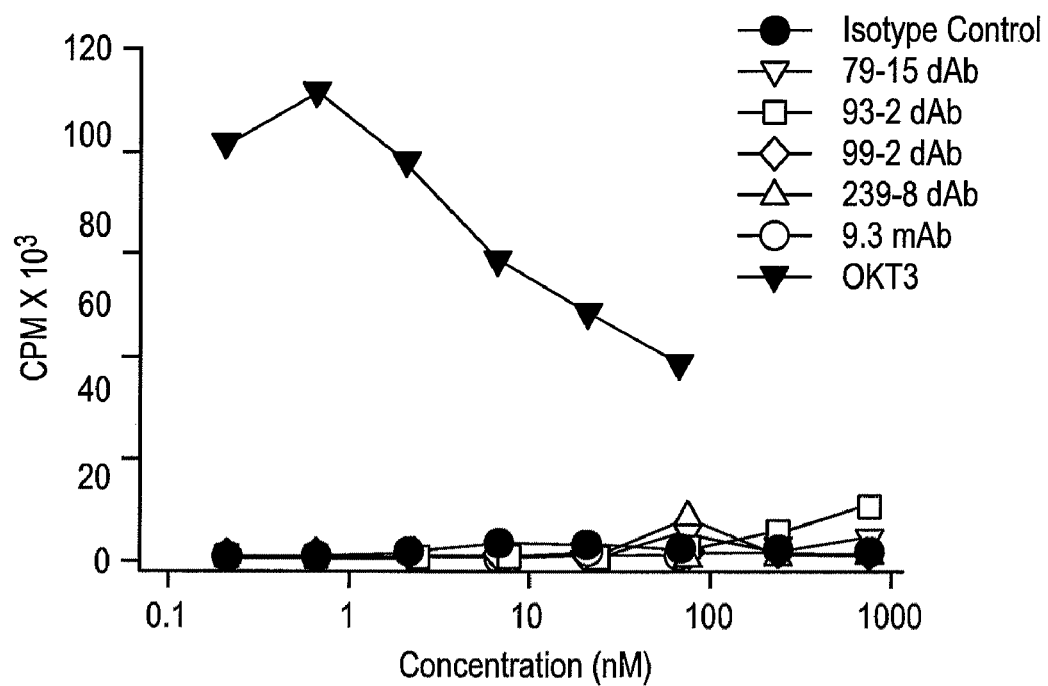

FIGS. 1A and 1B illustrate that anti-human CD28 dAbs set forth herein do not exhibit agonist activity. In a first experiment, PBMC were isolated from whole blood of normal donors and seeded into 96-well flat-bottom plates at $1 \times 10^5$ cells/well. Several dAbs as set forth herein were added to triplicate wells at the final concentrations indicated FIG. 1A. Anti-CD3 (OKT3, 1 µg/ml final concentration), was included as a positive control. Proliferation was measured by $^3$[H]-thymidine incorporation on day 3 (FIG. 1A). In a separate experiment, several dAbs set forth herein, anti-CD28 antibody (9.3), anti-CD3 antibody (OKT3), or isotype control were added to triplicate wells in a 96-well round-bottom plate at the final concentrations indicated and allowed to air-dry onto the wells. PBMC were added (1×10$^5$ cells/well) and proliferation was measured by $^3$[H]-thymidine incorporation on day 3.

The data obtained for dAbs in both the IL-2 reporter assay and in the mixed-lymphocyte reaction assay is assembled for comparison in Table 1 below. Based on the results of these experiments, as well as the results of the co-agonist experiments described herein, it is shown that the dAbs set forth herein bind with affinity and specificity to CD28, and that the dAbs are antagonistic with respect to CD28 activity. The dAbs also demonstrate little to no CD28 agonistic activity.

TABLE 1

Results of MLR assays and luciferase assays using dAbs set forth herein.

| dAb | Luciferase assay (EC$_{50}$) | MLR assay (EC$_{50}$) |
|---|---|---|
| VK dAbs: | | |
| 1h-239-850 (SEQ ID NO: 58) | 9 ± 6 nM | 2 ± 1 nM |
| 1h-35 (SEQ ID NO: 59) | 1.9 ± 0.5 µM | 2 ± 0.5 µM |
| 1h-36 (SEQ ID NO: 60) | 570 ± 220 nM | 1.8 ± 1 µM |
| 1h-79 (SEQ ID NO: 61) | 3.8 ± 0.6 µM | 3.2 ± 0.5 µM |
| 1h-80 (SEQ ID NO: 62) | 685 ± 370 nM | 2 ± 0.4 µM |
| 1h-83 (SEQ ID NO: 63) | 1.3 ± 0.5 µM | 1.7 ± 1 µM |
| 1h-108 (SEQ ID NO: 64) | 1.9 ± 0 µM | 2.7 ± 0.9 µM |
| 1h-203 (SEQ ID NO: 65) | 880 ± 140 nM | — |
| 1h-207 (SEQ ID NO: 66) | 2.6 µM | — |
| 1h-238 (SEQ ID NO: 67) | 775 ± 260 nM | — |
| 1h-239 (SEQ ID NO: 68) | 1.3 ± 0.1 µM | — |
| 1h-18-1 (SEQ ID NO: 69) | 5.4 ± 0.3 µM | — |
| 1h-18-3 (SEQ ID NO: 71) | 1 ± 0 µM | — |
| 1h-18-5 (SEQ ID NO: 73) | >7 µM | — |
| 1h-18-6 (SEQ ID NO: 74) | 1.4 ± 0.1 µM | — |
| 1h-31 (SEQ ID NO: 77) | 800 ± 140 nM | — |
| 1h-32 (SEQ ID NO: 78) | 4.5 µM | — |
| 1h-33 (SEQ ID NO: 79) | 1.6 ± 0.1 µM | — |
| 1h-34 (SEQ ID NO: 80) | 2.9 ± 0.4 µM | — |
| 1h-35 (SEQ ID NO: 81) | 1.9 ± 0.5 µM | 2 ± 0.5 µM |
| 1h-35-2 (SEQ ID NO: 83) | 279 ± 93 nM | 197 ± 72 nM |
| 1h-35-5 (SEQ ID NO: 84) | 261 ± 30 nM | 248 ± 16 nM |
| 1h-35-7 (SEQ ID NO: 85) | 79 ± 9 nM | 270 ± 102 nM |
| 1h-35-9 (SEQ ID NO: 86) | 278 ± 11 nM | 318 ± 11 nM |
| 1h-36 (SEQ ID NO: 87) | 570 ± 220 nM | 1.8 ± 1 µM |
| 1h-36-6 (SEQ ID NO: 93) | 162 ± 86 nM | 260 ± 120 nM |
| 1h-38 (SEQ ID NO: 95) | 650 ± 70 nM | 725 ± 204 nM |
| 1h-39 (SEQ ID NO: 96) | 1.3 ± 0.5 µM | — |
| 1h-69 (SEQ ID NO: 97) | >7 µM | — |
| 1h-70 (SEQ ID NO: 98) | 6.6 µM | — |
| 1h-71 (SEQ ID NO: 99) | 3.5 ± 0.7. µM | — |
| 1h-72 (SEQ ID NO: 100) | 3.4 ± 1 µM | — |
| 1h-73 (SEQ ID NO: 101) | 4.9 ± 1 µM | — |
| 1h-74 (SEQ ID NO: 102) | 1.3 ± 0.3 µM | — |
| 1h-75 (SEQ ID NO: 103) | 5.7 ± 1 µM | — |
| 1h-76 (SEQ ID NO: 104) | 1.8 ± 0.3 µM | — |
| 1h-79 (SEQ ID NO: 107) | 3.8 ± 0.6 µM | 3.2 ± 0.5 µM |
| 1h-79-1 (SEQ ID NO: 108) | 418 ± 90 µM | 2.1 ± 1.5 µM |
| 1h-79-15 (SEQ ID NO: 111) | 40 nM | 268 ± 7 nM |
| 1h-79-1505 (SEQ ID NO: 112) | 103 ± 29 nM | — |
| 1h-79-1512 (SEQ ID NO: 113) | 19 ± 2 nM | 9 ± 6 nM |
| 1h-79-1519 (SEQ ID NO: 114) | 97 ± 18 nM | 37 ± 36 nM |
| 1h-79-1520 (SEQ ID NO: 115) | 113 ± 30 nM | 68 ± 4 nM |
| 1h-79-17 (SEQ ID NO: 117) | 2.5 ± 0.2 µM | — |
| 1h-79-2 (SEQ ID NO: 120) | 166 ± 47 nM | — |
| 1h-79-20 (SEQ ID NO: 121) | 1.8 ± 0.6 µM | — |
| 1h-79-21 (SEQ ID NO: 122) | 3 ± 1 µM | — |
| 1h-79-22 (SEQ ID NO: 123) | 750 ± 212 nM | — |
| 1h-79-24 (SEQ ID NO: 125) | 331 ± 104 nM | 295 ± 115 nM |
| 1h-79-26 (SEQ ID NO: 127) | 62 ± 11 nM | 38 ± 20 nM |
| 1h-79-28 (SEQ ID NO: 129) | 40 nM | 109 ± 59 nM |
| 1h-79-29 (SEQ ID NO: 130) | 43 ± 9 nM | 150 ± 89 nM |
| 1h-79-30 (SEQ ID NO: 132) | 224 ± 54 nM | 126 ± 29 nM |
| 1h-79-31 (SEQ ID NO: 133) | 141 ± 62 nM | 103 ± 56 nM |
| 1h-79-32 (SEQ ID NO: 134) | 68 ± 6 nM | — |
| 1h-79-8 (SEQ ID NO: 139) | 240 ± 6 nM | — |
| 1h-79-802 (SEQ ID NO: 141) | 421 ± 147 nM | 48 ± 8 nM |
| 1h-79-806 (SEQ ID NO: 145) | 40 ± 3 nM | 26 ± 8 nM |
| 1h-79-807 (SEQ ID NO: 146) | 31 nM | 53 ± 6 nM |
| 1h-79-808 (SEQ ID NO: 147) | 560 ± 334 nM | — |
| 1h-79-809 (SEQ ID NO: 148) | 592 nM | — |

TABLE 1-continued

Results of MLR assays and luciferase assays using dAbs set forth herein.

| dAb | Luciferase assay (EC$_{50}$) | MLR assay (EC$_{50}$) |
|---|---|---|
| 1h-80 (SEQ ID NO: 156) | 685 ± 370 nM | 2 ± 0.4 µM |
| 1h-80-1 (SEQ ID NO: 157) | 366 ± 56 nM | 438 ± 370 nM |
| 1h-80-2 (SEQ ID NO: 161) | 62 nM | 550 ± 140 nM |
| 1h-80-7 (SEQ ID NO: 166) | 322 ± 42 nM | — |
| 1h-81 (SEQ ID NO: 169) | 3.3 ± 2 µM | — |
| 1h-82 (SEQ ID NO: 170) | 1.9 ± 0.07 µM | — |
| 1h-83 (SEQ ID NO: 171) | 1.3 ± 0.5 µM | 1.7 ± 1 µM |
| 1h-84 (SEQ ID NO: 172) | 1.5 ± 0.4 µM | — |
| 1h-85 (SEQ ID NO: 173) | 530 ± 150 nM | — |
| 1h-86 (SEQ ID NO: 174) | 400 ± 0 nM | — |
| 1h-87 (SEQ ID NO: 175) | 1.7 ± 0.3 µM | — |
| 1h-90 (SEQ ID NO: 178) | 1.0 ± 0 µM | — |
| 1h-108 (SEQ ID NO: 180) | 1.9 ± 0 µM | 2.7 ± 0.9 µM |
| 1h-108-5 (SEQ ID NO: 188) | 1.9 ± 0 µM | — |
| 1h-109 (SEQ ID NO193:) | 1 ± 0 µM | — |
| 1h-110 (SEQ ID NO194:) | 4.1 ± 1 µM | — |
| 1h-112 (SEQ ID NO: 397) | 775 ± 430 nM | 850 ± 320 nM |
| 1h-116 (SEQ ID NO: 196) | 2.5 ± 1.9 µM | 2.4 ± 1.2 µM |
| 1h-203 (SEQ ID NO: 200) | 880 ± 140 nM | — |
| 1h-207 (SEQ ID NO: 206) | 2.6 µM | — |
| 1h-238 (SEQ ID NO: 226) | 775 ± 260 nM | — |
| 1h-239 (SEQ ID NO: 227) | 1.3 ± 0.1 µM | — |
| 1h-239-8 (SEQ ID NO: 228) | 10 ± 4 nM | 13 ± 3 nM |
| 1h-239-804 (SEQ ID NO: 229) | 5 ± 2 nM | 3 ± 2 nM |
| 1h-239-807 (SEQ ID NO: 230) | 7 ± 2 nM | 6 ± 1 nM |
| 1h-239-809 (SEQ ID NO: 231) | 6 ± 1 nM | 4 ± 1 nM |
| 1h-239-815 (SEQ ID NO: 232) | 10 nM | 6 ± 4 nM |
| 1h-239-816 (SEQ ID NO: 233) | 11 ± 7 nM | 13 ± 3 nM |
| 1h-239-817 (SEQ ID NO: 234) | 7 nM | 9 ± 2 nM |
| 1h-239-819 (SEQ ID NO: 235) | 13 ± 5 nM | 11 ± 8 nM |
| 1h-239-824 (SEQ ID NO: 236) | 9 nM | 6 ± 1 nM |
| 1h-239-828 (SEQ ID NO: 237) | 8 nM | 14 ± 6 nM |
| 1h-239-829 (SEQ ID NO: 238) | 10 ± 3 nM | 11 ± 2 nM |
| 1h-239-832 (SEQ ID NO: 239) | 12 ± 6 nM | 11 ± 6 nM |
| 1h-239-833 (SEQ ID NO: 240) | 8 ± 1 nM | 7 ± 0.7 nM |
| 1h-239-837 (SEQ ID NO: 241) | 9 ± 1 nM | 14 ± 6 nM |
| 1h-239-838 (SEQ ID NO: 242) | 4 ± 0.6 nM | 3 ± 2 nM |
| 1h-239-840 (SEQ ID NO: 243) | 9 nM | 10 ± 1 nM |
| 1h-239-847 (SEQ ID NO: 244) | 8 ± 3 nM | 5 ± 3 nM |
| 1h-239-849 (SEQ ID NO: 245) | 13 ± 4 nM | 10 ± 7 nM |
| 1h-239-850 (SEQ ID NO: 246) | 9 ± 6 nM | 2 ± 1 nM |
| 1h-239-851 (SEQ ID NO: 247) | 5 nM | 4 ± 0.7 nM |
| 1h-239-856 (SEQ ID NO: 248) | 3 nM | 1 nM |
| 1h-239-857 (SEQ ID NO: 249) | 3 ± 0.7 nM | 1 nM |
| 1h-239-859 (SEQ ID NO: 250) | 5 ± 0.6 nM | 4 ± 1 nM |
| 1h-239-869 (SEQ ID NO: 255) | — | 2 ± 0 nM |
| 1h-239-870 (SEQ ID NO: 256) | — | 3 ± 0.7 nM |
| 1h-239-871 (SEQ ID NO: 257) | — | 3 ± 0 nM |
| 1h-239-9 (SEQ ID NO: 271) | 27 ± 6 nM | 57 ± 13 nM |
| 1h-239-872 (SEQ ID NO: 258) | 0.6 | 0.5 ± 0.2 |
| 1h-239-873 (SEQ ID NO: 259) | 1.4 ± 0.1 | 1 ± 0 |
| 1h-239-874 (SEQ ID NO: 260) | — | 2 ± 0 |
| 1h-239-875 (SEQ ID NO: 261) | 0.8 ± 0.1 | 0.9 ± 0.6 |
| 1h-239-876 (SEQ ID NO: 262) | 1.2 ± 1 | 1.8 ± 1.4 |
| 1h-239-877 (SEQ ID NO: 263) | 2.2 ± 0.3 | 2 ± 0 |
| 1h-239-879 (SEQ ID NO: 264) | 1 ± 0 | 1.3 ± 0.9 |
| 1h-239-880 (SEQ ID NO: 265) | 0.8 ± 0.2 | 0.6 ± 0.2 |
| 1h-239-881 (SEQ ID NO: 266) | 1 ± 0 | 1.3 ± 0.9 |
| 1h-239-882 (SEQ ID NO: 267) | 0.5 ± 0.1 | 0.5 ± 0.3 |
| 1h-239-883 (SEQ ID NO: 268) | 1.5 ± 0.7 | 1 ± 0.5 |
| 1h-239-885 (SEQ ID NO: 269) | 1.2 ± 0.4 | 0.9 ± 0.6 |
| 1h-239-886 (SEQ ID NO: 270) | 0.8 ± 0.1 | 0.9 ± 0.6 |
| 1h-239-887 (SEQ ID NO: 472) | 0.2 | 1 ± 0.7 |
| 1h-239-888 (SEQ ID NO: 473) | 1.7 | 62 ± 43 |
| 1h-239-889 (SEQ ID NO: 474) | 0.2 | 0.7 ± 0.5 |
| 1h-239-890 (SEQ ID NO: 475) | 0.2 | 0.7 ± 0.5 |
| 1h-239-891 (SEQ ID NO: 476) | 0.2 | 0.5 ± 0.3 |
| 1h-239-892 (SEQ ID NO: 477) | 0.3 | 0.6 ± 0.2 |
| 1h-239-893 (SEQ ID NO: 478) | 0.4 | 0.6 ± 0.2 |
| 1h-239-894 (SEQ ID NO: 479) | 0.4 | 0.3 ± 0.3 |
| 1h-239-895 (SEQ ID NO: 480) | 0.3 | 0.8 ± 0.3 |
| 1h-239-896 (SEQ ID NO: 481) | 0.2 | 0.5 ± 0.05 |
| 1h-239-897 (SEQ ID NO: 482) | 0.4 | 0.6 ± 0.2 |
| 1h-239-898 (SEQ ID NO: 483) | 0.5 | 0.8 ± 0.2 |

TABLE 1-continued

Results of MLR assays and luciferase assays using dAbs set forth herein.

| dAb | Luciferase assay (EC$_{50}$) | MLR assay (EC$_{50}$) |
|---|---|---|
| 1h-239-89103 (SEQ ID NO: 534) | — | 0.7 ± 0.2 |
| 1h-239-89104 (SEQ ID NO: 535) | — | 0.8 ± 0.3 |
| 1h-239-89201 (SEQ ID NO: 547) | — | 0.6 ± 0.1 |
| 1h-239-89202 (SEQ ID NO: 548) | — | 2 ± 0 |
| 1h-239-89204 (SEQ ID NO: 550) | — | 0.9 ± 0.2 |
| 1h-239-89205 (SEQ ID NO: 551) | — | 0.6 ± 0.3 |
| 1h-239-89207 (SEQ ID NO: 553) | — | 0.5 ± 0.2 |
| 1h-239-89216 (SEQ ID NO: 562) | — | 0.8 ± 0.2 |
| 1h-239-89230 (SEQ ID NO: 567) | — | 1.8 ± 0.3 |
| 1h-239-89233 (SEQ ID NO: 570) | — | 0.8 ± 0.3 |
| 1h-239-89221 (SEQ ID NO: 575) | — | 0.9 ± 0.3 |
| 1h-239-89222 (SEQ ID NO: 576) | — | 0.9 ± 0.2 |
| 1h-239-89223 (SEQ ID NO: 577) | — | 0.9 ± 0.2 |
| 1h-239-89224 (SEQ ID NO: 578) | — | 1.6 ± 0.8 |
| 1h-239-89226 (SEQ ID NO: 580) | — | 0.8 ± 0.3 |
| VH dAbs | | |
| 1h-99-237 (SEQ ID NO: 272) | 3 ± 0.8 nM | 3 ± 1.8 nM |
| 1h-99-238 (SEQ ID NO: 273) | 3 ± 1 nM | 5 ± 2 nM |
| 1h-37 (SEQ ID NO: 274) | 1.3 ± 0.6 μM | 1.9 ± 0.8 μM |
| 1h-93 (SEQ ID NO: 275) | 2.8 ± 0.9 μM | 3.2 ± 0.7 μM |
| 1h-99 (SEQ ID NO: 276) | 3.2 ± 0.1 μM | 2.2 ± 0.8 μM |
| 1h-29 (SEQ ID NO: 281) | >7 μM | — |
| 1h-30 (SEQ ID NO: 282) | 1.2 ± 0 μM | — |
| 1h-37 (SEQ ID NO: 283) | 1.3 ± 0.6 μM | 1.9 ± 0.8 μM |
| 1h-93 (SEQ ID NO: 287) | 2.8 ± 0.9 μM | 3.2 ± 0.7 μM |
| 1h-93-1 (SEQ ID NO: 288) | 493 ± 26 nM | 545 ± 224 nM |
| 1h-93-2 (SEQ ID NO: 289) | 383 ± 80 nM | 830 ± 165 nM |
| 1h-93-201 (SEQ ID NO: 290) | 182 ± 58 nM | 18 ± 8 nM |
| 1h-93-204 (SEQ ID NO: 291) | 176 ± 79 nM | 1.2 ± 1.4 μM |
| 1h-99 (SEQ ID NO: 297) | 3.2 ± 0.1 μM | 2.2 ± 0.8 μM |
| 1h-99-1 (SEQ ID NO: 298) | 15 ± 0 nM | 19 ± 14 nM |
| 1h-99-2 (SEQ ID NO: 299) | 17 ± 2 nM | 13 ± 6 nM |
| 1h-99-201 (SEQ ID NO: 300) | 14 ± 4 nM | 18 ± 1 nM |
| 1h-99-203 (SEQ ID NO: 301) | 8 ± 0 nM | 10 ± 0 nM |
| 1h-99-2112 (SEQ ID NO: 311) | 3 ± 1 nM | 2 ± 1 nM |
| 1h-99-2113 (SEQ ID NO: 312) | 5 ± 2 nM | 3 ± 1 nM |
| 1h-99-2114 (SEQ ID NO: 313) | 4 ± 1 nM | 2 ± 1 nM |
| 1h-99-2115 (SEQ ID NO: 314) | 3 ± 2 nM | 12 ± 4 nM |
| 1h-99-2116 (SEQ ID NO: 315) | 5 ± 2 nM | 4 ± 1 nM |
| 1h-99-217 (SEQ ID NO: 320) | 12 ± 2 nM | 15 ± 2 nM |
| 1h-99-218 (SEQ ID NO: 321) | 10 ± 2 nM | 12 ± 1 nM |
| 1h-99-220 (SEQ ID NO: 323) | 10 ± 1 nM | 12 ± 1 nM |
| 1h-99-221 (SEQ ID NO: 324) | 12 ± 1 nM | 17 ± 4 nM |
| 1h-99-222 (SEQ ID NO: 325) | 16 ± 2 nM | 28 ± 16 nM |
| 1h-99-224 (SEQ ID NO: 327) | 15 ± 1 nM | 28 ± 9 nM |
| 1h-99-225 (SEQ ID NO: 328) | 14 ± 4 nM | 28 ± 12 nM |
| 1h-99-226 (SEQ ID NO: 329) | 10 ± 1 nM | 23 ± 2 nM |
| 1h-99-227 (SEQ ID NO: 330) | 18 ± 3 nM | 33 ± 18 nM |
| 1h-99-228 (SEQ ID NO: 331) | 12 ± 8 nM | 46 ± 6 nM |
| 1h-99-229 (SEQ ID NO: 332) | 15 ± 3 nM | 24 ± 4 nM |
| 1h-99-230 (SEQ ID NO: 333) | 9 ± 1 nM | 14 ± 6 nM |
| 1h-99-236 (SEQ ID NO: 339) | 21 ± 6 nM | 14 ± 9 nM |
| 1h-99-237 (SEQ ID NO: 340) | 3 ± 1 nM | 3 ± 2 nM |
| 1h-99-238 (SEQ ID NO: 341) | 3 ± 1 nM | 5 ± 2 nM |
| 1h-99-241 (SEQ ID NO: 342) | 17 ± 1 nM | 22 nM |
| 1h-99-243 (SEQ ID NO: 343) | 4 ± 2 nM | 8 ± 1 nM |
| 1h-99-245 (SEQ ID NO: 345) | 6 ± 1 nM | 11 ± 1 nM |
| 1h-99-246 (SEQ ID NO: 346) | 3 ± 1 nM | 8 ± 1 nM |
| 1h-99-249 (SEQ ID NO: 349) | 6 ± 2 nM | 11 ± 2 nM |
| 1h-99-250 (SEQ ID NO: 350) | 9 ± 0 nM | 8 nM |
| 1h-99-254 (SEQ ID NO: 354) | 11 ± 1 nM | 7 nM |
| 1h-99-256 (SEQ ID NO: 356) | 9 ± 1 nM | 7 ± 4 nM |
| 1h-99-260 (SEQ ID NO: 360) | 11 ± 0 nM | 13 nM |
| 1h-99-262 (SEQ ID NO: 398) | 6 ± 2 nM | 8 ± 4 nM |
| 1h-99-263 (SEQ ID NO: 362) | 6 ± 1 nM | 4 ± 2 nM |
| 1h-99-264 (SEQ ID NO: 363) | 5 ± 2 nM | 3 ± 2 nM |
| 1h-99-265 (SEQ ID NO: 364) | 4 ± 1 nM | 3 ± 1 nM |
| 1h-99-266 (SEQ ID NO: 365) | 8 ± 4 nM | 4 ± 1 nM |
| 1h-99-267 (SEQ ID NO: 366) | 6 ± 3 nM | 4 ± 1 nM |
| 1h-99-268 (SEQ ID NO: 367) | 11 ± 2 nM | 13 ± 1 nM |
| 1h-99-269 (SEQ ID NO: 368) | 10 ± 2 nM | 5 ± 0 nM |
| 1h-99-270 (SEQ ID NO: 369) | 4 ± 2 nM | 6 ± 2 nM |
| 1h-99-275 (SEQ ID NO: 370) | 6 ± 1 nM | 10 ± 3 nM |
| 1h-99-276 (SEQ ID NO: 371) | 5 ± 1 nM | 18 ± 1 nM |

TABLE 1-continued

Results of MLR assays and luciferase assays using dAbs set forth herein.

| dAb | Luciferase assay ($EC_{50}$) | MLR assay ($EC_{50}$) |
|---|---|---|
| 1h-99-277 (SEQ ID NO: 372) | 6 ± 2 nM | 9 ± 1 nM |
| 1h-99-278 (SEQ ID NO: 373) | 12 ± 2 nM | 13 ± 1 nM |
| 1h-99-297 (SEQ ID NO: 374) | 6 ± 1 nM | 6 ± 0 nM |
| 1h-100 (SEQ ID NO: 380) | >7 µM | — |
| 1h-114 (SEQ ID NO: 388) | 3.1 ± 1.4 µM | — |
| 1h-115 (SEQ ID NO: 389) | 4 ± 1.6 µM | >7 µM |
| 1h-119 (SEQ ID NO: 392) | 2.8 µM | — |
| 1h-212 (SEQ ID NO: 393) | >7 µM | — |
| 1h-99-23703 (SEQ ID NO: 599) | — | 7 ± 3 |
| 1h-99-23704 (SEQ ID NO: 600) | — | 10 ± 1.4 |
| 1h-99-23711 (SEQ ID NO: 607) | — | 11 ± 2.6 |
| 1h-99-23715 (SEQ ID NO: 611) | — | 3.8 ± 1.3 |
| 1h-99-23721 (SEQ ID NO: 617) | — | 6.3 ± 2.8 |
| 1h-99-23726 (SEQ ID NO: 622) | — | 7.8 ± 3.2 |

Example 6

Polyethylene Glycol Modification of dAbs

PEGylation of various dAbs was undertaken to increase the stability, half-life, and bioavailability of dAbs set forth herein. For poly (ethylene glycol) (PEG)-modification ("PEGylation") of the N-terminal amine of dAbs, samples were purified and dialysed into phosphate-buffered saline (PBS) and the endotoxin levels in the solution were reduced to a maximum of 10 endotoxin units (EU)/mg (1 EU=100 pg lipopolysaccharide). Samples were then dialysed into 0.1 M potassium phosphate pH 6.8. Samples were filtered after dialysis, the protein concentration determined and adjusted to 2-3 mg/ml.

For the attachment of PEG (40 kD linear, 40 kD branched or 30 kD linear), a methoxy poly (ethylene glycol) propionaldehyde solid was added to solution in a 3 fold molar excess over dAb and mixed on a roller for 1 hour at room temperature. At that time, a 10-fold molar excess of sodium cyanoborohydride (from 5 mg/ml stock in 0.1M potassium phosphate pH 6.8) was added and mixed on a roller for 5 hours at room temperature. An additional 10-fold molar excess of sodium cyanoborhydride was added and the reaction allowed to proceed overnight at room temperature. The progression of PEGylation was monitored by SDS-PAGE.

For PEGylation of a cysteine residue in a dAb, either at the C-terminal position or at an internal position (e.g., amino acid position 15, 41, 60, 70, 81, or 100), dAbs were purified and dialysed into PBS, and endotoxin levels reduced to a maximum of 10 EU/mg. Samples were filtered after dialysis, and the dAb concentration determined and adjusted to 2-3 mg/ml.

For the attachment of PEG (40 kD linear, 40 kD branched or 30 kD linear), reduction of the dAb with dithiothreitol (DTT) was employed. Glycerol was added to the sample (20% (v/v)) and the sample thoroughly mixed before reduction with dithiothreitol (5 mM). The reaction was allowed to proceed at room temperature for 20 minutes before exchanging buffer into a PEG-coupling buffer (20 mM BIS-Tris pH 6.5, 5 mM EDTA and 10% glycerol [v/v]) using 26/10 Hi-Prep desalting column (GE Healthcare). The protein concentration was measured and adjusted to 2-3 mg/ml. Methoxy poly (ethylene glycol) maleimide solid was added to the solution in a 3 fold molar excess over the dAb and the solution mixed on a roller between 4 and 16 hours at room temperature. The progression of PEGylation was monitored by SDS-PAGE.

PEGylation was also carried out using reduction of the dAb with tris(2-carboxyethyl)phosphine (TCEP). The sample was dialyzed into PEG coupling buffer (20 mM BIS-Tris pH 6.5, 5 mM EDTA and 10% glycerol [v/v]) using a 26/10 HiPrep Desalting column (GE Healthcare). The concentration of dAb was measured and adjusted to 2-3 mg/ml. Reduction was carried out using TCEP, added at a concentration of 5 mM, for 20 minutes at room temperature. A methoxy poly (ethylene glycol) maleimide solid was then added in a 3-fold molar excess over the dAb and mixed on a roller for 4-16 hours at room temperature. The progression of PEGylation was monitored by SDS-PAGE.

When required, maleimide was used to block cysteine residues. Protein samples were purified and dialysed into PBS and endotoxin levels reduced to a maximum of 10 EU/mg. Samples were filtered after dialysis, and the protein concentration determined and adjusted to 2-3 mg/ml. For the addition of PEG, glycerol was added to the sample (20% (v/v) and thoroughly mixed before reduction with dithiothreitol (DTT 5 mM). The reaction was allowed to proceed at room temperature for 20 minutes before dialysis into PEG coupling buffer (20 mM BIS-Tris pH 6.5, 5 mM EDTA and 10% glycerol [v/v],) using 26/10 Hi-Prep Desalting column (GE Healthcare). The protein concentration was measured and adjusted to 2-3 mg/ml. Maleimide solid was added in a 3-fold molar excess over dAb and mixed using a roller for 4-16 hours at room temperature. The extent of the reaction was monitored using SDS-PAGE.

The method used for purification of PEGylated dAbs depends on the isoelectric point (pI) of the dAb. For dAbs with a pI lower than 7, anion exchange was used, whereas for dAbs with a pI higher than 7, cation exchange was appropriate.

For purification, dAbs were first diluted 1:5 with Buffer A (20 mM Tris pH 8 for anion exchange and 20 mM Sodium acetate pH 4 for cation exchange) and the pH checked. Resource Q (anion exchanger) and S (cation exchanger), or HiTrap Q or S Fast Flow columns (GE Healthcare) were used. The columns were washed with 10 column volumes 0.5 M NaOH, followed by 10 column volumes of Buffer B (20 mM Tris pH 8, using 1 M NaCl for anion exchange and 20 mM sodium acetate pH 4, using 1 M NaCl for cation exchange). The columns were equilibrated with Buffer A before loading of the diluted sample. Elution of the sample was carried out over the following gradients:

0-30% Buffer B over 30 column volumes,
30-100% Buffer B over 10 column volumes,
100% Buffer B over 5 column volumes.

Any excess free PEG or maliemide passed through the column and remained in the flow through. The PEGylated sample usually eluted in the first gradient and was well separated from the second gradient where the remaining un-PEGylated sample eluted. Two-milliliter fractions were collected throughout each gradient and are analyzed by SDS-PAGE. The columns were finally washed with 0.5 M NaOH to elute any remaining material. Appropriate fractions were pooled and, in the case of high-pI dAbs, the pH adjusted to neutral by addition of 1 M Tris, pH 8.

Tables 2 and 3 demonstrate that PEGylated dAbs retain binding activity and biological activity in the assays used herein.

TABLE 2

Activity of PEGylated human dAbs.

| Human CD28 dAb | Luciferase assay (EC$_{50}$ nM) | DC-MLR Assay (EC$_{50}$ nM) |
|---|---|---|
| 1h-99-2 | 17 ± 2 | 13 ± 6 |
| 1h-99-2 40K linear PEG | 100 ± 29 | 390 ± 145 |
| 1h-99.2 40K branched PEG | 117 | 383 ± 21 |
| 1h-99-237 | 3 ± 1 | 3 ± 2 |
| 1h-99-237 40K linear PEG | — | 2 ± 0 |
| 1h-99-238 | 3 ± 1 | 5 ± 2 |
| 1h-99-238 40K linear PEG | 4.5 ± 1 | 29 ± 8 |
| 1h-239-8 | 10 ± 4 | 13 ± 3 |
| 1h-239-8 40K linear PEG | 510 ± 100 | 285 |
| 1h-239-850 | 9 ± 6 | 2 ± 1 |
| 1h-239-850 40K linear PEG | 2 | 4 ± 0 |
| 1h-239-891 | 0.2 | 0.5 ± 0.3 |
| 1h-239-891(Q3C) 40K branched PEG | — | 1.5 ± 0.5 |
| 1h-239-891(S9C) 40K branched PEG | — | 1.3 ± 0.5 |
| 1h-239-891(G41C) 40K branched PEG | — | 2 ± 0 |
| 1h-239-891(K42C) 40K branched PEG | — | 13 ± 6 |
| 1h-239-891(S60C) 30K linear PEG | — | 0.8 ± 0.3 |
| 1h-239-891(S60C) 40K branched PEG | — | 1.2 ± 0.6 |
| 1h-239-891(D70C) 30K linear | — | 1.2 ± 0.5 |
| 1h-239-891(D70C) 40K branched | — | 2.3 ± 1.8 |
| 1h-239-891(Q79C) 40K branched PEG | — | 4.9 ± 1.9 |

TABLE 3

Activity of PEGylated mouse dAb

| mouse CD28 dAb | MLR Assay (EC$_{50}$ nM) |
|---|---|
| 74-15 | 11 ± 5 |
| 74-15 40K linear PEG | 20 ± 1 |

Example 7

Animal Cross-Reactivity Studies with dAbs

The ability of dAbs set forth herein to react with non-human cells and polypeptides was examined. In a cross-reactivity study, dAb 1 h-79-807 demonstrated activity against both human and mouse cells expressing CD28. For the human cell study, the luciferase and MLR assays were used, as described above. For the mouse cell study, MLR and mouse splenocyte assays were used. In the assays, dAb 1 h-79-807 exhibited a potency of 31+/−12 nM (splenocyte assay) and a potency of 38+/−6 nM (MLR assay).

For the mouse MLR assays, single cell suspensions were made from lymph nodes of a BALB\c mouse and spleens from a DBA\2 mouse using a Tenbroeck tissue homogenizer. The red blood cells were removed from both populations through lysis using Red Blood Cell Lysis buffer (SIGMA, St Louis, Mo.), followed by two washes in complete media [(RPMI 1640 (Invitrogen, Carlsbad, Calif.), 10% Fetal Calf Serum (Summit), 1% 1-glutamine (Invitrogen), 1% sodium pyruvate (Invitrogen), 100 µg/ml gentamicin (Invitrogen), 5×10$^{-5}$ M 2-mercaptoethanol (SIGMA)]. After the final wash, the cell pellets were resuspended in 2 ml of complete media, loaded onto individual pre-equilibrated nylon wool columns (WAKO, Richmond, Va.), and incubated at 37° C. for 60 min. The T cells from either the BALB/c lymph node and DBA\2 spleens were eluted from the column by the addition of 25 ml of warm media. The T cells from the DBA\2 spleens were discarded, and the APC population eluted from the column with the addition of 25 ml of ice cold complete media (describe supra). The BALB\c T cells or the DBA/2 APCs were centrifuged at 400×g for 10 minutes, resuspended in complete media, and the cells counted on a hemacytometer. Both cell populations were diluted to 1.0×10$^6$ cells/ml in complete media. DBA\2 APCs (0.25×10$^6$/ml) were combined with BALB\c T cells (0.5×10$^6$/ml) in a round-bottom 96-well plate (Becton Dickinson, Franklin Lakes, N.J.), and serial dilutions of dAb, or control agent, was added to the wells. The plates were incubated at 37° C. in 5% CO$_2$ for 96 hours. $^3$H-thymidine (1 µCi; PerkinElmer, Waltham, Mass.) was added to the wells 6 hours prior to the end of the incubation period. Plates were harvested through GF/c filter plates (PerkinElmer), dried, then 50 µl of Microscint-20 (PerkinElmer) added to each well, and radioactivity counted on a TopCount (Packard, Meriden, Conn.). Data was analyzed using the ExcelFit program (Microsoft, Redmond, Wash.).

F or the mouse splenocyte assay, single cell suspensions were generated from spleens of BALB\c mice using a Tenbroeck tissue homogenizer. The red blood cells were separated from other homogenate matter by incubation in Red Blood Cell Lysis buffer, followed by two washes in complete media [RPMI 1640 (Invitrogen), 10% Fetal Calf Serum (Summit), 1% 1-glutamine (Invitrogen), 1% Sodium Pyruvate (Invitrogen), 100 µg/ml gentamicin (Invitrogen), 5×10$^{-5}$ M 2-mercaptoethanol (SIGMA)]. After the final wash, the cell pellet was resuspended in complete media and splenocytes counted using a hemacytometer. The splenocytes were diluted to 1.0×10$^6$ cells/ml in complete medium, and 500 µl added to round-bottom 96-well plates. Anti-CD3 antibody (clone 145-2C11 (BMS)) was added to each well at a concentration of 0.1 µg/ml. Serial dilutions of dAb, or control agents, were added to the wells, incubated at 37° C. in 5% CO$_2$ for 48 hours. $^3$H-thymidine (1 µCi) was added to the wells 6 hours prior to the end of the incubation period, and the splenocytes harvested through GF/c filter plates (PerkinElmer). The plates were dried, 50 µl of Microscint-20 (PerkinElmer) was added to each well, and radioactivity counted on a TopCount. Data was analyzed using the ExcelFit program.

In another cross-reactivity study, the pharmacokinetics (PK) of dAbs were examined using Cynomolgus monkeys, in order to elucidate the PK in relation to size and conformation of polyethylene glycol (PEG)-modified ("PEGylated") dAbs. The effect of anti-human CD28 dAb 1 h 99-2-PEG, bearing a 40 kD PEG moiety, was examined in two groups, each containing three monkeys. Group 1 monkeys received dAb 1 h 99-2 P40-Branched PEG subcutaneously, at a concentration of 10 mg/kg. Group 2 monkeys received dAb 1 h 99-2 P40-Linear PEG subcutaneously, at a concentration of 10 mg/kg. All serum samples collected from animals were stored at −70° C. and analyzed at the conclusion of the study. Serum samples were analyzed using ELISA and MSD at several dilutions.

For the ELISA analysis, biotin-monomeric CD28 was coated on an ELISA plates at a concentration of 1 μg/ml. Standards, quality control samples, and all experimental sample dilutions were prepared at final serum concentration of 1%. Cynomolgus samples were thawed at room temperature and several dilutions of the samples were prepared to identify signals within the assay range. Cynomolgus samples were added to the wells on the ELISA plate and incubated for two hours at room temperature. Rabbit anti-Vh dAbs were prepared and isolated using affinity purification and a polyclonal antibody. Donkey anti-rabbit—HRP was added to the plates, followed by substrate, and after the reaction proceeded for a measured amount of time, the reaction was stopped. The optical density (OD) of the each reaction was measured using a microplate optical reader. A standard curve was generated, and a four-parameter logistic fit of the standard curve was used to calculate dAb concentrations in the wells based on the OD readings within the quantifiable range. Results were based on an average of concentrations from multiple dilutions.

Figure 5:
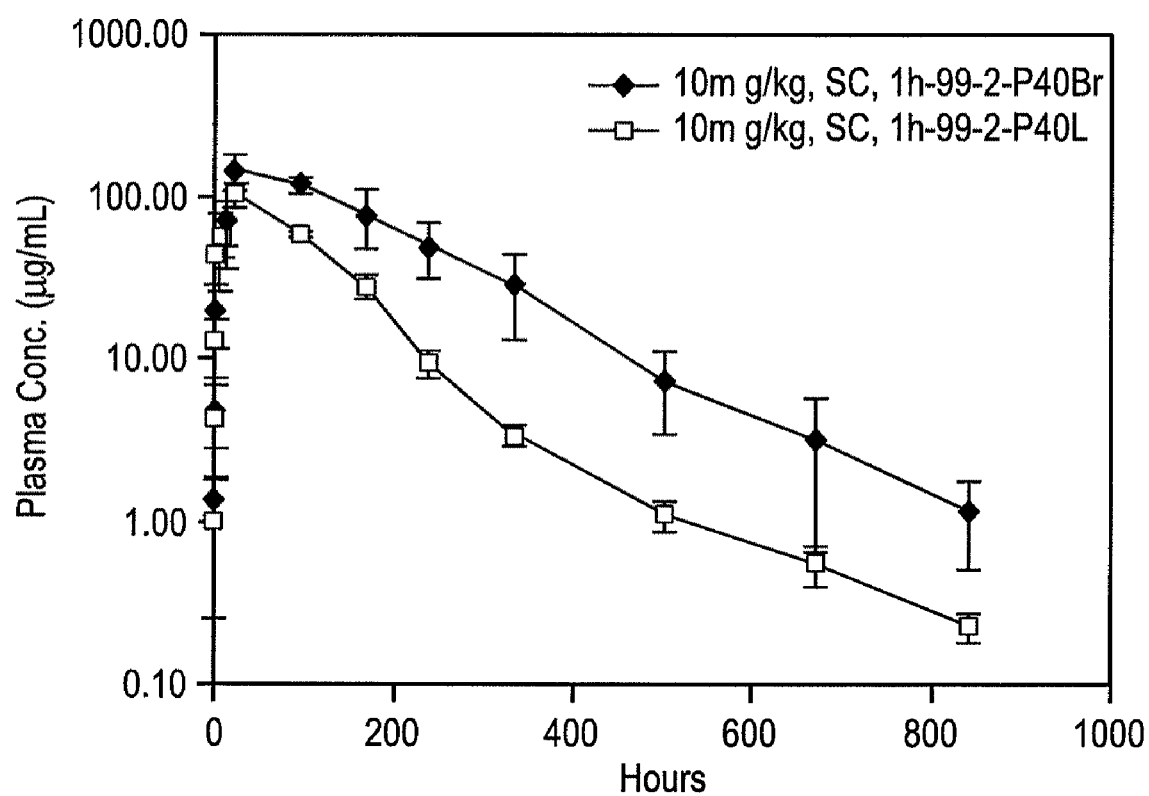
FIG. 5 depicts the plasma concentration of dAbs 1 h-99-2P40-branched and 1 h-99-2P40-linear over time in a Cynomolgus monkey study.

Tables 4-6 describe the results obtained from the administration of dAb 1 h 99-2 P40-Branched and dAb 1 h 99-2 P40-Linear to Cynomolgus monkeys. FIG. 5 illustrates the plasma concentration, over time, of the study of the PEGylated dAbs in the monkeys.

The experimental results with branched PEGylated dAb differed from those for the linear PEGylated dAb in both exposure and terminal half-life, which may be due to the difference in absorption rather than disposition.

Although the half-life ($T_{1/2}$) of the branched dAb ($T_{1/2}$=4.5 days) appeared to be shorter than that of the linear dAb ($T_{1/2}$=6 days), the branched-PEG dAb is a better candidate in terms of exposure and potential coverage over the target concentration (e.g., the in vitro $IC_{50}$=3 μg/mL or 200 nM). The AUC of the branched dAb was ~2.5 fold greater than that of the linear dAb (single factor Anova P=0.017). The mean residence time (MRT) of the branched dAb was ~1.5 fold higher than that of linear dAb.

After subcutaneous administration, the peak concentrations of both PEGylated proteins occurred around 24 hours. The steady state volume of distribution (Vss/F) values for both dAbs were below 100 mL/kg, indicating that the PEGylated proteins largely reside in the plasma.

TABLE 4

Serum levels of dAb 1h 99-2 P40-Branched
Group 1: 1h 99-2 p40Br (μg/ml)

| Hours post dose | Monkey # | | | MEAN | SD |
|---|---|---|---|---|---|
| | 1101 | 1102 | 1103 | | |
| 1 | 0.592 | 2.916 | 0.671 | 1.39 | 1.32 |
| 2 | 3.398 | 7.989 | 2.839 | 4.74 | 2.83 |
| 4 | 28.494 | 17.417 | 12.747 | 19.55 | 8.09 |
| 8 | 75.129 | 61.516 | 40.057 | 58.90 | 17.68 |
| 12 | 80.598 | 82.753 | 44.651 | 69.33 | 21.40 |
| 24 | 174.252 | 144.025 | 107.507 | 141.93 | 33.42 |
| 96 | 125.813 | 109.162 | 107.421 | 114.13 | 10.15 |
| 168 | 71.762 | 111.085 | 49.670 | 77.51 | 31.11 |
| 240 | 45.573 | 68.400 | 32.332 | 48.77 | 18.25 |
| 336 | 22.922 | 45.246 | 16.363 | 28.18 | 15.14 |
| 504 | 7.441 | 10.925 | 3.379 | 7.25 | 3.78 |
| 672 | 2.187 | 5.836 | 1.204 | 3.08 | 2.44 |
| 840 | 0.810 | 1.861 | 0.747 | 1.14 | 0.63 |

TABLE 5

Serum levels of dAb 1h 99-2 P40-Linear
Group 2: 1h 99-2 P40L (μg/ml)

| Hours post dose | Monkey # | | | MEAN | SD |
|---|---|---|---|---|---|
| | 2101 | 2102 | 2103 | | |
| 1 | 1.335 | 0.137 | 1.524 | 1.00 | 0.75 |
| 2 | 5.540 | 1.427 | 5.500 | 4.16 | 2.36 |
| 4 | 15.190 | 5.990 | 15.062 | 12.08 | 5.28 |
| 8 | 42.403 | 26.227 | 61.192 | 43.27 | 17.50 |
| 12 | 67.873 | 31.246 | 67.810 | 55.64 | 21.13 |
| 24 | 111.762 | 82.306 | 107.172 | 100.41 | 15.85 |
| 96 | 57.389 | 55.502 | 58.679 | 57.19 | 1.60 |
| 168 | 23.335 | 31.518 | 26.847 | 27.23 | 4.11 |
| 240 | 7.744 | 11.258 | 8.730 | 9.24 | 1.81 |
| 336 | 2.946 | 3.276 | 3.895 | 3.37 | 0.48 |
| 504 | 0.850 | 1.303 | 1.131 | 1.09 | 0.23 |
| 672 | 0.394 | 0.693 | 0.542 | 0.54 | 0.15 |
| 840 | 0.202 | 0.275 | 0.197 | 0.22 | 0.04 |

TABLE 6

Summary of pharmacokinetic (PK) parameters for PEGylated dAbs

| Study | Unit | Group 1: 1h-99-2 P40Br | | Group 2: 1h-99-2 P40L | |
|---|---|---|---|---|---|
| | | Mean | SD | Mean | SD |
| Dose | mg/kg | 10 | | 10 | |
| Cmax | μg/mL | 141.9 | 33.42 | 100.4 | 15.85 |
| Tmax | h | 24 | 0 | 24 | 0 |
| AUClast | μg/ml * h | 29414 | 7618 | 11978 | 531.4 |
| AUCtot | μg/ml * h | 29576 | 7730 | 12024 | 518.7 |
| T½ | h | 105.41 | 7.80 | 142.2 | 21.04 |
| MRT | h | 174.13 | 27.25 | 117.1 | 11.98 |
| Clearance/F | mL/min/kg | 0.00592 | 0.002 | 0.0139 | 0.0006 |
| Vss/F | mL/kg | 60.43 | 10.54 | 97.69 | 13.56 |

The data in Experimental Example 7, as well as in Tables 4-6 demonstrates that dAbs set forth herein are cross-reactive human, mouse, and monkey model systems. Furthermore, the pharmacokinetic parameters for PEGylated dAbs demonstrate that the dAbs are bioavailable and active in living subjects.

Example 8

Method for SEC-MALLS Analysis of dAbs

In order to estimate solution size and oligomeric structure of dAbs, multi-angle laser light scattering was used in conjunction with size-exclusion chromatography. Polypeptide samples were purified and dialysed into appropriate buffer (i.e., PBS). Samples were filtered after dialysis, concentration determined and adjusted to 1 mg/ml. BSA was purchased from Sigma and used without further purification.

A Shimadzu LC-20AD Prominence HPLC system with an autosampler (SIL-20A) and SPD-20A Prominence UV/Visible light detector was connected to Wyatt Mini Dawn Treos (MALLS, multi-angle laser light scattering detector) and Wyatt Optilab rEX DRI (differential refractive index) detector. The detectors were connected in the following order—LS-UV-RI. Both RI and LS instruments operated at a wavelength of 488 nm. TSK2000 (Tosoh corporation) or BioSep2000 (Phenomenex) columns were used (both are silica-based HPLC columns with similar separation range, 1-300 kD) with mobile phase of 50 mM phosphate buffer (with or without salt), pH 7.4 or 1×PBS. To improve recovery of the protein from the column, 10% ethanol was sometimes added. The flow rate used was either 0.5 or 1.0 ml/min, and the time course of the run was adjusted to reflect different flow rates (45 or 23 minutes) and was not expected to have significant impact onto separation of the molecules. Proteins were prepared in PBS to a concentration of 1 mg/ml and the injection volume was 100 µl.

The light-scattering detector was calibrated with toluene according to the manufacturer's instructions. The UV detector output and RI detector output were connected to the light scattering instrument so that the signals from all three detectors could be simultaneously collected with the Wyatt ASTRA software. Several injections of BSA in a mobile phase of PBS (0.5 or 1 ml/min.) were run over a Tosoh TSK2000 column with UV, LS and RI signals collected by the Wyatt software. The traces are then analyzed using ASTRA software, and the signals were normalized aligned and corrected for band broadening following manufacturer's instructions. Calibration constants were then averaged and input into the template which is used for future sample runs.

Absolute Molar Mass Calculations

One hundred microliters of 1 mg/ml sample were injected onto appropriate pre-equilibrated column. After processing through the SEC column, the sample passed through 3 on-line detectors—UV, MALLS (multi-angle laser light scattering) and DRI (differential refractive index), allowing absolute molar mass determination. The dilution that takes place on the column is about 10-fold, so the concentration at which in-solution state was determined was 100 µg/ml, or about 8 uM dAb.

The basis of the calculations in ASTRA as well as of the Zimm plot technique, which is often implemented in a batch sample mode is the equation from Zimm (1948) *J. Chem. Phys.* 16:1093-1099:

$$\frac{R\theta}{K^*C} = MP(\theta) - 2A_2cM^2P^2(\theta) \quad \text{(Eq. 1)}$$

wherein
c is the mass concentration of the solute molecules in the solvent (g/mL)
M is the weight average molar mass (g/mol)
$A_2$ is the second virial coefficient (mol mL/g$^2$)
$K^*=4p^2n_0^2 (dn/dc)^2 l_0^{-4} N_A^{-1}$ is an optical constant where $n_0$ is the refractive index of the solvent at the incident radiation (vacuum) wavelength, $l_0$ is the incident radiation (vacuum) wavelength, expressed in nanometers, $N_A$ is Avogadro's number, equal to $6.022\times10^{23}$ mol$^{-1}$, and dn/dc is the differential refractive index increment of the solvent-solute solution with respect to a change in solute concentration, expressed in mL/g (this factor must be measured independently using a dRI detector).
P(q) is the theoretically-derived form factor, approximately equal to $1-2\mu^2<r^2>/3!+ \ldots$, where $\mu=(4\pi/\lambda)\sin(\theta/2)$, and $<r^2>$ is the mean square radius. P(q) is a function of the molecules' z-average size, shape, and structure.
$R_q$ is the excess Rayleigh ratio (cm$^{-1}$)
This equation assumes vertically polarized incident light and is valid to order c$^2$.

To perform calculations with the Zimm fit method, which is a fit to $R_q/K^*c$ vs. sin$^2$(q/2), we need to expand the reciprocal of Eq. 1 first order in c:

To perform calculations with the Zimm fit method, which is a fit to $R_q/K^*c$ vs. sin 2(q/2), we need to expand the reciprocal of Eq. 1 to first order in c:

$$\frac{K^x c}{R_\theta} = \frac{1}{MP(\theta)} + 2A_2 c \quad \text{(Eq. 2)}$$

The appropriate results in this case were $$M = ([K^x c/R_0] - 2A_2 c)^{-1} \quad \text{(Eq. 3)}$$

and $$\langle r^2 \rangle = \frac{3m_0 \lambda^2 M}{16\pi^2} \quad \text{(Eq. 4)}$$

where $$m_0 = d[K^x c/R_\theta]/d[\sin^2(\theta/2)]_{\theta \to 0} \quad \text{(Eq. 5)}$$

The calculations were performed automatically by ASTRA software, resulting in a plot with molar mass determined for each of the data slices. Molar mass values obtained from the plot for each of the peaks observed on chromatogram was compared with expected molecular mass of a single unit of the protein. This enables a determination of in-solution state of the protein.

TABLE 7

Solution State and Size of dAbs

| dAb | SEC-MALLS | MW | Column & mobile phase |
|---|---|---|---|
| 1h-35 | Monomer/dimer equilibrium | 20 kD | BioSep 2000, PBS pH 7.4, 0.5 ml/min |
| 1h-36 | Monomer | 16 kD | BioSep 2000, PBS pH 7.4, 0.5 ml/min |
| 1h-37 | Monomer | 15 kD | BioSep 2000, PBS pH 7.4, 0.5 ml/min |
| 1h-79 | Monomer/dimer equilibrium | 21 kD | TSK2000, PBS pH 7.4 10% Ethanol, 0.5 ml/min |
| 1h-80 | Monomer/dimer equilibrium | 17 kD | BioSep 2000, PBS pH 7.4, 0.5 ml/min |
| 1h-83 | Monomer | 16 kD | BioSep 2000, PBS pH 7.4, 0.5 ml/min |
| 1h-93 | Monomer | 16 kD | BioSep 2000, PBS pH 7.4, 0.5 ml/min |
| 1h-99 | Monomer/dimer equilibrium | 19 kD | BioSep 2000, PBS pH 7.4, 0.5 ml/min |
| 1h-108 | Monomer | 17 kD | TSK2000, PBS pH 7.4 10% Ethanol, 0.5 ml/min |
| 1h-99-237 | Monomer | 12 kD | TSK2000, PBS pH 7.4 10% Ethanol, 1.0 ml/min |
| 1h-99-238 | Monomer plus dimer | 12 & 26 kD | TSK2000, PBS pH 7.4 10% Ethanol, 1.0 ml/min |
| 1h-239-850 | Monomer/dimer equilibrium | 21 kD | TSK2000, PBS pH 7.4 10% Ethanol, 1.0 ml/min |

Example 9

Anti-CD28 dAbs Inhibit Cytokine Production in the Context of a DC-Driven MLR

This example demonstrates that anti-CD28 domain antibodies are capable of inhibiting cytokine production in the context of a dendritic cell-driven MLR.

Peripheral blood mononuclear cells (PBMC) were obtained by density-gradient separation of whole blood from normal human donors. T cells were prepared from E+ fractions of PBMC rosetted with sheep red blood cells (Colorado Serum Company). Dendritic cells (DCs) were generated by adherence of monocytes from E− fractions of PBMC to plastic and culture with GM-CSF and IL-4 (Invitrogen) for 7 days, followed by the addition of LPS (Sigma, 1 μg/ml) for 24 hours to induce maturation. Anti-CD28 domain antibodies were titrated in half log dilutions for a nine point dose response curve to evaluate their inhibition of a 1:10 ratio of dendritic cell to T cell interaction. Cytokine production was measured in supernatants by commercial ELISA (R&D Systems). IL-2 and IFNγ were measured on day 2 after stimulation, and TNFα was measured on day 3. Proliferation was measured by $^3$[H]-thymidine incorporation on day 5. $EC_{50}$ values were generated from inhibition curves of each treatment. Results are shown in Table 8. "239-891-D70C P30L PEG" and "239-891-D70C P40B PEG" below stand for the anti-CD28 human Vκ domain antibody (dAb) 1 h-239-891-D70C PEGylated with either a 30 kDa linear or 40 kDa branched polyethylene glycol, respectively.

TABLE 8

| Anti-CD28 dAb | IL-2 ($EC_{50}$ nM) | TNFα ($EC_{50}$ nM) | IFNγ ($EC_{50}$ nM) |
|---|---|---|---|
| | (n = 4) | (n = 6) | (n = 4) |
| 99-265 | 2.4 ± 0.4 | 3.6 ± 0.6 | 4.6 ± 0.8 |
| 239-890 | 0.1 ± 0.03 | 0.2 ± 0.04 | 0.3 ± 0.14 |
| 239-891 | 0.1 ± 0.06 | 0.2 ± 0.06 | 0.2 ± 0.08 |
| 239-896 | 0.3 ± 0.04 | 0.3 ± 0.06 | 0.3 ± 0.05 |
| | (n = 10) | (n = 10) | (n = 10) |
| 239-891-D70C P30L PEG | 0.6 ± 0.09 | 0.6 ± 0.1 | 0.6 ± 0.08 |
| 239-891-D70C P40B PEG | 1.5 ± 0.2 | 1.7 ± 0.36 | 2.5 ± 0.5 |

Example 10

CD28 dAbs are Equally Effective in Inhibiting CD80 vs CD86-Driven T Cell Proliferation This example demonstrates that anti-CD28 domain antibodies inhibit both CD80- and CD86-driven T cell proliferation.

T cells were prepared from E+ fractions of PBMC rosetted with sheep red blood cells. Chinese hamster ovary (CHO) cells stably transfected with either human CD80 or CD86 were combined with T cells in the presence of 1 μg/ml of αCD3 (OKT3). The anti-CD28 domain antibodies were titrated in half log dilutions for a nine point dose response curve to evaluate their inhibition of a 1:3 ratio of CD80- or CD86-CHO to T cell interaction. Proliferation was measured by $^3$[H]-thymidine incorporation on day 5. $EC_{50}$ values were generated from inhibition curves of each treatment. Results are shown in Table 9.

TABLE 9

| dAb | CD80 CHO ($EC_{50}$ nM) | CD86 CHO ($EC_{50}$ nM) |
|---|---|---|
| 239-891 | 0.3 ± 0.1 (n = 9) | 0.4 ± 0.1 (n = 9) |
| 239-891-D70C P30L PEG | 1 ± 0.2 (n = 5) | 0.5 ± 0.2 (n = 5) |
| 239-891-D70C P40Br PEG | 0.4 ± 0.05 (n = 5) | 0.4 ± 0.05 (n = 5) |

Example 11

CD28 dAbs Inhibit T Cell Proliferation Initiated By Different APCs

This example demonstrates that anti-CD28 domain antibodies inhibit T cell proliferation initiated by different antigen presenting cells.

T cells were prepared from E+ fractions of PBMC rosetted with sheep red blood cells (Colorado Serum Company). Dendritic cells (DCs) were generated by adherence of monocytes from E− fractions of PBMC to plastic and culture with GM-CSF and IL-4 (Invitrogen) for 7 days, followed by the addition of LPS (Sigma, 1 μg/ml) for 24 hours to induce maturation. Monocytes were prepared from E− fractions of PBMC by elutriation. The lymphoblastoid cell line (PM-LCL) is an EBV-transformed B-cell line from a normal donor. The various APCs were combined with allogeneic T cells at a ratio of 1:50. Anti-CD28 domain antibodies were titrated in half log dilutions for a nine point dose response curve to evaluate their inhibition of proliferation, which was measured by $^3$[H]-thymidine incorporation on day 5. $EC_{50}$ values were generated from inhibition curves of each treatment. Results are shown in Table 10.

TABLE 10

| dAb | DCs | LCL B cells | Monocytes |
|---|---|---|---|
| 239-891 (n = 2) | 0.2, 0.2 | 0.3, 0.1 | 0.2, 1.4 |
| 239-891-D70C P30L PEG | 0.5 ± 0.1 | 0.8 ± 0.3 | 2.3 ± 0.8 |
| 239-891-D70C P40B PEG | 1.2 ± 0.1 | 2.4 ± 0.4 | 10 ± 4 |

Example 12

Anti-CD28 Domain Antibodies Lack Agonist Activity

This example demonstrates that anti-CD28 domain antibodies lack agonist activity.

Figure 10A:
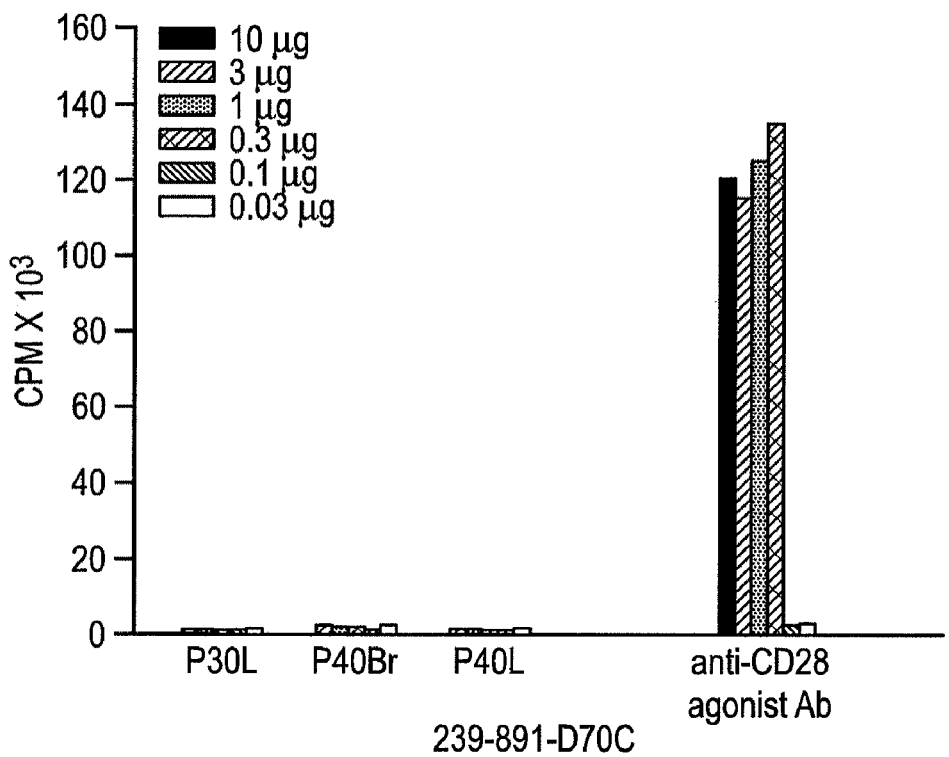
In FIG. 10A, PBMC were exposed to the anti-CD28 domain antibody 239-891-D70C or the mitogenic anti-CD28 antibody 5.11A1. Cell proliferation was measured by $^3$[H]-thymidine incorporation on day 3, as shown in FIG. 10A, and IL-2 production was measured, as shown in FIG. 10B.
Figure 10B:
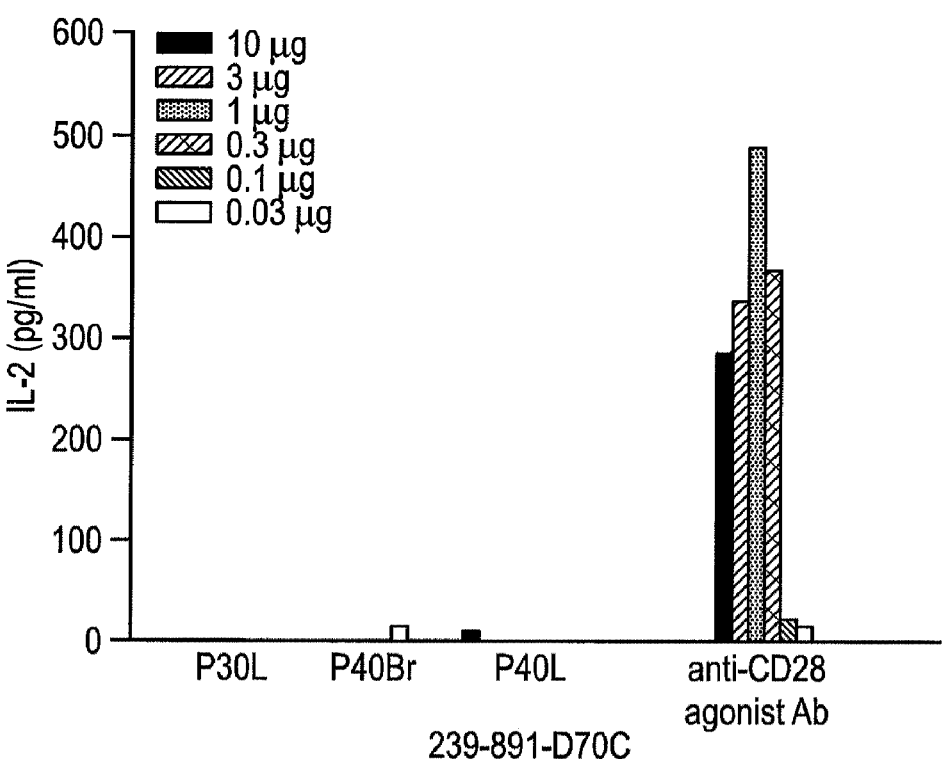
FIG. 10 shows that anti-CD28 domain antibodies lack agonist activity.

The anti-CD28 domain antibody 239-891-D70C and the mitogenic anti-human CD28 antibody 5.11A1 were separately titrated in half-log dilutions in PBS, coated in the bottom of 96-well round-bottom plates and allowed to air-dry. PBMC were isolated from whole blood of normal human donors and added to wells containing the air-dried antibodies. Proliferation was measured by $^3$[H]-thymidine incorporation on day 3, as shown in FIG. 10A, and IL-2 production was measured, as shown in FIG. 10B.

Example 13

Anti-CD28 Domain Antibodies Bind Their Target In Vivo and Lack Agonist Activity

This example demonstrates that anti-CD28 domain antibodies bind their target in vivo and lack agonist activity.

Cynomolgus monkeys were administered a single subcutaneous dose of the anti-CD28 human Vκ domain antibody (dAb) 1 h-239-891-D70C PEGylated with either a 30 kDa linear or 40 kDa branched polyethylene glycol (PEG).

CD28 receptor occupancy (RO) on peripheral-blood T-helper cells (CD3+CD4+CD8−) was monitored at 2, 4, 24, 48, 96, 168, 240, 336, 408, 504, and 672 hours postdose using flow cytometry. Up to 100% RO was observed and sustained for a duration that correlated with plasma drug concentrations.

Although non-human primates are not sensitive to cytokine release syndrome (CRS) per se (reviewed in Horvath and Milton, Toxicol. Pathol. 37(3): 372-383 (2009)), the presence of moderate increases in cytokine concentrations may be useful to predict CRS in humans. Thus, plasma cytokine concentrations (IL-1β, IL-2, IL-5, IL-6, IFN-γ, and TNF-α) were evaluated predose and at 2, 4, 8, and 24 hours postdose using a multiplex bead-based assay. No drug-related cytokine release was observed, with most cytokine concentrations falling below the limit of detection. The absence of even moderate effects of this dAb on plasma cytokine concentrations supports a lack of agonistic activity.

Due to the absence of CRS in nonhuman primates, monitoring of peripheral-blood T-cell counts might predict unwanted T cell activation and T cell depletion in humans (Horvath and Milton (2009) Toxicol. Pathol. 37(3): 372-83). Thus, peripheral-blood T-cell counts were monitored at 2, 4, 24, 48, 96, 168, 240, 336, 408, 504, and 672 hours postdose using flow cytometry. There were no rapid or profound changes in peripheral-blood T-cell counts akin to those observed in humans following a single-dose of the superagonistic monoclonal antibody TGN 1412 (Suntharalingam et al. (2006) New Engl. J. Med. 355(10): 1018-28) or in non-human primates following dosing with OKT3 and HuM291 (reviewed in Horvath and Milton, 2009). The lack of any rapid and/or profound effects of this dAb on peripheral-blood T-cell counts supports a lack of agonistic activity.

All patents, patent applications, and published references cited herein are hereby incorporated by reference in their entirety. The disclosure set forth herein has been particularly shown and described with references to specific embodiments thereof. It will be understood by those skilled in the art that various changes in form and details may be made therein without departing from the scope encompassed by the appended claims.

SEQUENCE LISTING (644 sequences)

SEQ ID NO: 1 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgatgcgtattcgatgatttgggtccgccaggctccagggaagggtctagagtgggtctcaactattactccgcagggtgataggacatactacgcagactccgtgaagggccggttcaccatctcccgcgacaattccaagaacacgctgtatctgcaaatgaacagcctgcgtgccgaggacaccgcggtatattactgtgcgcaagctggttggagttttgactactggggtcagggaaccctggtcaccgtctcgagc

SEQ ID NO: 2 - DNA, 349 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgtggattatgagatggcttgggtccgccaggctccagggaagggtctagagtgggtctcaactatttcgaatgatggcgctgctacatactacgcagactccgtgaagggccggttcaccatctcccgcgacaattccaagaacacgctgtatctgcaaatgaacagcctgcgtgccgaggacaccgcggtatattactgtgcgaaagatgatgctgcttttgactactggggtcagggagccctggtcaccgtctcgagcg

SEQ ID NO: 3 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggtgcgtattctatggggtgggcccgccaggctccagggaagggtctagagtgggtctcatggattacggggaatggtggttctacatactacgcagactccgtgaagggccggttcaccatctcccgcgacaattccaagaacacgctgtatctgcaaatgaacagcctgcgtgccgaggacaccgcggtatattactgtgcgaaagcggaggagccgtttgactactggggtcagggaaccctggtcaccgtctcgagc

SEQ ID NO: 4 - DNA, 349 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttagtaggtatcatatggcgtgggtccgccaggctccagggaagggtctagagtgggtctcagtgattgattctcttggtcttcagacatactacgcagactccgtgaagggccggttcaccatctcccgcgacaattccaagaacacgctgtatctgcaaatgaacagcctgcgtgccgaggacaccgcggtatattactgtgcggaatatggtggtgcgtttgactactggggtcagggaaccctggtcaccgtctcgagcg

SEQ ID NO: 5 - DNA, 352 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttactcattattctatggggtgggtccgccaggctccagggaagggtctagagtgggtctcacatattactccggatggtcttattacatactacgcagactccgtgaagggccggttcaccatctcccgcgacaattccaagaacacgctgtatctgcaaatgaacagcctgcgtgccgaggataccgcggtatattactgtgcgaaaggtaggttggttgattttgactactggggtcagggaaccctggtcaccgtctcgagcg

SEQ ID NO: 6 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagaattatggtatggcttgggtccgccaggctccagggaagggtctagagtgggtctcaaatattggtcgggctggtagtgttacatactacgcagactccgtgaagggccggttcaccatctcccgcgacaattccaagaacacgctgtatctgcaaatgaacagcctgcgtgccgaggacaccgcggtatattactgtgcgaaagttcagtcgtggaggacttttgactactggggtcagggaaccctggtcaccgtctcgagc

SEQ ID NO: 7 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcctgcgtattctatggggtgggtccgccaggctccagagaagggtctagagtgggtctcatatattgatgggcgtggtgctgagacatactacgcagactccgtgaagggccggttcaccatctcccgcgacaattccaagaacacgctgtatctgcaaatgaacagcctgcgcgccgaggataccgcggtatattactgtgcgaaaattgatactctgatttctgagtttgactactggggtcagggaaccctggtcaccgtctcgagc

SEQ ID NO: 8 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcctaattatacgatgtggtgggtccgccaggctccagggaagggtctagagtgggtctcatctattagtggtactggtcatactacatactacgcagactccgtgaagggccggttcaccatctcccgcgacaattccaagaacacgctgtatctgcaaatgaacagcctgcgtgccgaggataccgcggtatattactgtgcgaaatttgggcctaataatcctatgtttgactactggggtcagggaaccctggtcaccgtctcgagc

SEQ ID NO: 9 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgcgagttatgatatgggttgggtccgccaggctccagggaagggtctagagtgggtctcagcgatttcggcggatggtacgtttacatactacgcagactccgtgaagggccggttcaccatctcccgcgacaattccaagaacacgctgtatctgcaaatgaacagcctgcgtgccgaggacaccgcggtatattactgtgcgaaatcttcttttgataagtataattttgactactggggtcagggaaccctggtcaccgtctcgagc

SEQ ID NO: 10 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgctaagtatacgatgtggtgggtccgccaggctccagggaagggtctagagtgggtctcaagtattgatcctgttggtaatttgacatactacgcagactccgtgaagggccggttcaccatctcccgcgacaattccaagaacacgctgtatctgcaaatgaacagcctgcgtgccgaggacaccgcggtatattactgtgcgaaaagggggccgacgtcgtctaattttgactactggggtcagggaaccctggtcaccgtctcgagc

SEQ ID NO: 11 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttagtgagtatggtatgaagtgggtccgccaggctccagggaagggtctagagtgggtctcaacgattgataatgttggttcggtgacatactacgcagactccgtgaagggccggttcaccatctcccgcgacaattccaagaacacgctgtatctgcaaatgaacagcctgcgtgccgaggacaccgcggtatattactgtgcgaaaactacgcctgttttgctgccgctttttgactactggggtcagggaaccctggtcaccgtctcgagc

SEQ ID NO: 12 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgattcttataatatgggttgggtccgccaggctccagggaagggtcttgagtgggtctcagctattgcggctaatggtcgtgtgacatactacgcagactccgtgaagggccggttcaccatctcccgcgacaattccaagaacacgctgtatctgcaaatgaacagcctgcgtgccgaggacaccgcggtatattactgtgcgaaaatgacgaatatggcgtatggtagttttgactactggggtcagggaaccctggtcaccgtctcgagc

SEQ ID NO: 13 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgatctgtattcgatggcttgggtccgccaggctccagggaagggtctggagtgggtctcacatattgatagggctggtatgattacatactacgcagactccgtgaagggccggttcaccatctcccgcgacaattccaagaacacgctgtatctgcaaatgaacagcctgcgtgccgaggacaccgcggtatattactgtgcgaaagtttctaatgctgttaatatgcagtttgactactggggtcagggaaccctggtcaccgtctcgagc

SEQ ID NO: 14 - DNA, 360 bp, Artificial Sequence
  Description of Artificial Sequence: Synthetic polynucleotide
  modified_base (347)..(347): a, c, g, t, unknown or other
gaggtgcagctgttggagtctgggggaggcttggtacagcctggggggtccctgcgtctctcctgtgcagcctccggattcacctttgctaagtatacgatgtggtgggtccgccaggctccagggaagggtctagagtgggtctcaagtattgatcctgttggtaatttgacatactacgcagactccgtgaagggccggttcaccatctcccgcgacaattccaagaacacgctgtatctgcaaatgaacagcctgcgtgccgaggacaccgcggtatattactgtgcgaaacgtcataggccttcgacgcaggattttgactactggggtcagggaaccctggncaccgtctcgagc

SEQ ID NO: 15 - DNA, 361 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttcctgattataagatgggttgggtccgccaggctccagggaagggtctagagtgggtctcatggattgataagggtggtattattacatactacgcagactccgtgaagggccggttcaccatctcccgcgacaattccaagaacacgctgtatctgcaaatgaacagcctgcgtgccgaggataccgcggtatattactgtgcgaaaatgtttcctaagtttcggccggcttttgactactggggtcagggaaccctggtcaccgtctcgagcg

SEQ ID NO: 16 - DNA, 361 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgaggattatgggatggggtgggtccgccaggctccagggaagggtctagagtgggtctcacatattaatcgttctggtctggttacatactacgcagactccgtgaagggccggttcaccatctcccgcgacaattccaagaacacgctgtatctgcaaatgaacagcctgcgtgccgaggacaccgcggtatattactgtgcgaaagttctgaatgctcctaattttaagtttgactactggggtcagggaaccctggtcaccgtctcgagcg

SEQ ID NO: 17 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaatcgttatgcgatgggttgggtccgccaggctccagggaagggtctagagtgggtctcatggattgatggtaatggtctggttacatactacgcagactccgtgaagggccggttcaccatctcccgcgacaattccaagaacacgctgtatctgcaaatgaacagcctgcgtgccgaggacaccgcggtatattactgtgcgaaacggactaggtctcattctgattcgggttgggcttttgactactggggtcagggaaccctggtcaccgtctcgagc

SEQ ID NO: 18 - DNA, 325 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagtatattggtacttcgttaaattggtaccagcagaaaccagggaaagcccctaagctcctgacctatcaggcttccttgttgcaaagtggggtcccatcacgtttcagtggcagtggatctgggacagatttcactctcaccatcagcagtctgcaacctgaagattttgctacgtactactgtcaacagttggcgctgcgtcctatgacgttcggccaagggaccaaggtggaaatcaaacggg

SEQ ID NO: 19 - DNA, 370 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggtaattataatatggggtgggtccgccaggctccagggaagggtctagagtgggtctcaggtattacgaagggtggtcgggtgacatactacgcagactccgtgaagggccggttcaccatctcccgcgacaattccaagaacacgctgtatctgcaaatgaacagcctgcgtgccgaggataccgcggtatattactgtgcgaaattgggtccgtcgaggatgcttaatgagccgctgtttgactactggggtcagggaaccctggtcaccgtctcgagcg

SEQ ID NO: 20 - DNA, 370 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttccggcgtattcgatgatttgggtccgccaggctccagggaagggtctagagtgggtctcaacgatttcgccgctgggttattcgacatactacgcagactccgtgaagggccggttcaccatctcccgcgacaattccaagaacacgctgtatctgcaaatgaacagcctgcgtgccgaggacaccgcggtatattactgtgcggaacagacggcttatttgaatcgtgctacggagcattttgactactggggtcagggaaccctggtcaccgtctcgagcg

SEQ ID NO: 21 - DNA, 370 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttcgaagtatgatatggcttgggtccgccaggctccagggaagggtctggagtgggtctcatcgatttatgctattggtggtaatacatactacgcagactccgtgaagggccggttcaccatctcccgcgacaattccaagaacacgctgtatctgcaaatgaacagcctgcgtgccgaggacaccgcggtatattactgtgcgaaattgaagtcggggatgcagactcggttgaattcttttgactactggggtcagggaaccctggtcaccgtctcgagcg

SEQ ID NO: 22 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagctgtatcagatgggttgggtccgccaggctccagggaagggtctagagtgggtctcaactattatgcctagtggtaatcttacatactacgcagactccgtgaagggccggttcaccatctcccgcgacaattccaagaacacgctgtatctgcaaatgaacagcctgcgtgccgaggataccgcggtatattactgtgcgaaaatgtggtcgttgaatttggggtttcatgcggcttttgactactggggtcagggaaccctggtcaccgtctcgagc

SEQ ID NO: 23 - DNA, 370 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgggcagtatggtatgggttgggtccgccaggctccagggaagggtctagagtgggtctcagggattagtccttctggtaattatacatactacgcagactccgtgaagggccggttcaccatctcccgcgacaattccaagaacacgctgtatctgcaaatgaacagcctgcgtgccgaggataccgcggtatattactgtgcgaaagggaatgggtctcttccgcctcgtgggtctatttttgactactggggtcagggaaccctggtcaccgtctcgagcg

SEQ ID NO: 24 - DNA, 370 bp, Artificial Sequence; identical to SEQ ID NO: 19
  Description of Artificial Sequence: Synthetic polynucleotide

SEQ ID NO: 25 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgggacgtattatatggggtgggcccgccaggctccagggaagggtctagagtgggtctcatctattggggctaatggtgctcctacatattacgcagactccgtgaagggccggttcaccatctcccgcgacaattccaagaacacgctgtatctgcaaatgaacagcctgcgtgccgaggataccgcggtatattactgtgcgaaaattcgttcgcttaataggtgggcggagcctgtgtttgactactggggtcagggaaccctggtcaccgtctcgagc

SEQ ID NO: 26 - DNA, 349 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgctgattattctatgtattgggtccgccaggctccagggaagggtctggagtgggtctcacagattagtccggcgggttcttttacatactacgcagactccgtgaagggccggttcaccatctcccgcgacaattccaagaacacgctgtatctgcaaatgaacagcctgcgtgccgaggataccgcggtatattactgtgcgaaagattctaagtcttttgactactggggtcagggaaccctggtcaccgtctcgagcg

SEQ ID NO: 27 - DNA, 325 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagagtattgggacgggtttacggtggtaccagcagaaaccagggaaagcccctatgctcctgatctatcgggcgtccattttgcaaagtggggtcccatcacgttttagtggcagtggatctgggacagatttcactctcaccatcagcagtctgcaacctgaagattttgctacgtactactgtcaacagacgactcttcagccttttacgttcagccaagggactaaggtggaaatcaaacggg

SEQ ID NO: 28 - DNA, 325 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagtctattagtcattcgttagtttggtaccagcagaaaccagggaaagcccctaagctcctgatctattgggcttcccttttgcaaagtggggtcccatcacgtttcagtggcagtggatctgggacagatttcactctcaccatcagcagtctgcaacctgaagattttgctacgtactactgtcaacagggtatgactacgccttttacgttcggccaagggaccaaggtggaaatcaaacggg

SEQ ID NO: 29 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgatagttatgatatgaattgggtccgccaggctccagggaagggtctagagtgggtctcacagatttctgctgatggtcattttacatactacgcagactccgtgaagggccggttcaccatctcccgcgacaattccaagaacacgctgtatctgcaaatgaacagcctgcgtgccgaggacaccgcggtatattactgtgcgaaatcgcggagtagttttgactactggggtcagggaaccctggtcaccgtctcgagc

SEQ ID NO: 30 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttagggattatatgatggggtgggtccgccaggctccagggaagggtctagagtgggtctcacgtattgattctcatggtaatcgtacatactacgcagactccgtgaagggccggttcaccatctcccgcgacaattccaagaacacgctgtatctgcaaatgaacagcctgcgtgccgaggacaccgcggtatattactgtgcgaaacatatgacgggttttgactactggggtcagggaaccctggtcaccgtctcgagc

SEQ ID NO: 31 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttagggagtatatgatggggtgggtccgccaggctccagggaagggtctagagtgggtctcacgtattaatggtgtgggtaattctacatactacgcagactccgtgaagggccggttcaccatctcccgcgacaattccaagaacacgctgtatctgcaaatgaacagcctgcgtgccgaggacaccgcggtatattactgtgcgaaacatcaggtgggttttgactactggggtcagggaaccctggtcaccgtctcgagc

SEQ ID NO: 32 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttagtgattatatgatgggttgggtccgccaggctccagggaagggtctagagtgggtctcacgtattacgtctgagggttcgcatacatactacgcagactccgtgaagggccggttcaccatctcccgcgacaattccaagaacacgctgtatctgcaaatgaacagcctgcgtgccgaggacaccgcggtatattactgtgcgaaacatacgtctggttttgactactggggtcagggaaccctggtcaccgtctcgagc

SEQ ID NO: 33 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgggaggtatatgatggggtgggtccgccaggctccagggaagggtctggagtgggtctcacggatttctggtcctggtacggttacatactacgcagactccgtgaagggccggttcaccatctcccgcgacaattccaagaacacgctgtatctgcaaatgaacagcctgcgtgccgaggacaccgcggtatattactgtgcgaaacatgatacggggtttgactactggggtcagggaaccctggtcaccgtctcgagc

SEQ ID NO: 34 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcaccttttcttcttatgctatgatttgggtccgccaggctccagggaagggtctagagtgggtctcagagatttctccttatggtaatcatacatactacgcagactccgtgaagggccggttcaccatctcccgcgacaattccaagaacacgctgtatctgcaaatgaacagcctgcgtgccgaggacaccgcggtatattactgtgcgaaacctgatcggcgttttgactactggggtcagggaaccctggtcaccgtctcgagc

SEQ ID NO: 35 - DNA, 348 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttacttcgtatgggatgcagtgggtccgccaggctccagggaagggtctagagtgggtctcatcgatttctactgatggtatggttacatactacgcagactccgtgaagggccggttcaccatctcccgcgacaattccaagaacacgctgtatctgcaaatgaacagcctgcgtgccgaggataccgcggtatattactgtgcgaaacttggggttaattttgactactggggtcagggaaccctggtcaccgtctcgagc

SEQ ID NO: 36 - DNA, 351 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggtgattatatgatggggtgggtccgccaggctccagggaagggtctggagtgggtctcaattattcgtgtgcctggttcgactacatactacgcagactccgtgaagggccggttcaccatctcccgcgacaattccaagaacacgctgtatctgcaaatgaacagcctgcgtgccgaggacaccgcggtatattactgtgcgaaacagaagggtgatgagtttgactactggggtcagggaaccctggtcaccgtctcgagc

SEQ ID NO: 37 - DNA, 351 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttattctgtatgatatgcagtgggtccgccaggctccagggaagggtctagagtgggtctcacgtatttctgctaatggtcatgatacatactacgcagactccgtgaagggccggttcaccatctcccgcgacaattccaagaacacgctgtatctgcaaatgaacagcctgcgtgccgaggacaccgcggtatattactgtgcgaaaggtccgcattatttgtttgactactggggtcagggaaccctggtcaccgtctcgagc

SEQ ID NO: 38 - DNA, 351 bp, Artificial Sequence
  Description of Artificial Sequence: Synthetic polynucleotide
gaggtgcagctgttggagtctgggggaggcttggtacagcctggggggtccctgcgtctctcctgcgcagcctccggattcacctttactaagtattttatgggttgggtccgccaggctccagggaagggtctagagtgggtctcactgattgatccgcgtggtcctcatacatactacgcagactccgtgaagggccggttcaccatctcccgcgacaattccaagaacacgctgtatctgcaaatgaacagcctgcgtgccgaggacaccgcggtatattactgtgcgaaacagttgggtgaggagtttgactactggggtcagggaaccctggtcaccgtctcgagc

SEQ ID NO: 39 - DNA, 351 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttaagacttatacgatgaggtgggtccgccaggctccagggaagggtctagagtgggtctcaactattaattcgagtggtactttgacatactacgcagactccgtgaagggccggttcaccatctcccgcgacaattccaagaacacgctgtatctgcaaatgaacagcctgcgtgccgaggataccgcggtatattactgtgcgaaatctagttcttatacgtttgactactggggtcagggaaccctggtcaccgtctcgagc

SEQ ID NO: 40 - DNA, 354 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgcgatgtatagtatgaagtgggtccgccaggctccagggaagggtctagagtgggtctcatcgatttcgaatgctggtgatattacatactacgcagactccgtgaagggccggttcaccatctcccgcgacaattccaagaacacgctgtatctgcaaatgaacagcctgcgtgccgaggataccgcggtatattactgtgcggaatcgtttaggtctcgttattttgactactggggtcagggaaccctggtcaccgtctcgagc

SEQ ID NO: 41 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgatgattatcttatggggtgggtccgccaggctccagggaagggtctggagtgggtctcactgattcgtatgaggggttctgttacatactacgcagactccgtgaagggccggttcaccatctcccgcgacaattccaagaacacgctgtatctgcaaatgaacagcctgcgtgccgaggacaccgcggtatattactgtgcgaaacattctcttactactaatctttttgactactggggtcagggaaccctggtcaccgtctcgagc

SEQ ID NO: 42 - DNA, 357 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttactgattatatgatggcttgggcccgccaggctccagggaagggtctagagtgggtctcaattattgggactactggtacgtggacatactacgcagactccgtgaagggccggttcaccatctcccgcgacaattccaagaacacgctgtatctgcaaatgaacagcctgcgtgccgaggacaccgcggtatattactgtgcgaaaactaatgcgtatgagagtgagtttgactactggggtcagggaaccctggtcaccgtctcgagc

SEQ ID NO: 43 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgcgcggtatactatggtgtgggtccgccaggctccagggaagggtctagagtgggtctcagctattcattttgatggtcggactacatactacgcagactccgtgaagggccggttcaccatctcccgcgacaattccaagaacacgctgtatctgcaaatgaatagcctgcgtgccgaggacaccgcggtatattactgtgcgaaaaatgagtgggcgtctcttaagcattttgactactggggtcagggaaccctggtcaccgtctcgagc

SEQ ID NO: 44 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgaggattatatgatgggttgggtccgccaggctccagggaagggtctagagtgggtctcatttattaatctgcctggtggtcgtacatactacgcagactccgtgaagggccggttcaccatctcccgcgacaattccaagaacacgctgtatctgcaaatgaacagcctgcgtgccgaggacaccgcggtatattactgtgcgaaacagactcatgggctgactggttattttgactactggggtcagggaaccctggtcaccgtctcgagc

SEQ ID NO: 45 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggtttgtatggtatggcttgggcccgccaggctccagggaagggtctagagtgggtctcatcgattgggatgcatggtgatactacatactacgcagactccgtgaagggccggttcaccatctcccgcgacaattccaagaacacgctgtatctgcaaatgaacagcctgcgtgccgaggacaccgcggtatattactgtgcgaaagtttgtggggctacgtattgtaattttgactactggggtcagggaaccctggtcaccgtctcgagc

SEQ ID NO: 46 - DNA, 360 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggtaagtatgttatggcttgggtccgccaggctccagggaagggtctagagtgggtctcaattattgattccttgggttctactacatactacgcagactccgtgaagggccggttcaccatctcccgcgacaattccaagaacacgctgtatctgcaaatgaacagcctgcgtgccgaggacaccgcggtatattactgtgcgaaagggggtttgttggttcattatgattttgactactggggtcagggaaccctggtcaccgtctcgagc

SEQ ID NO: 47 - DNA, 363 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgaggtgtatggtatgtcttgggcccgccaggctccagggaagggtctagagtgggtctcattgattgatgcgggtggtcggaatacatactacgcagactccgtgaagggccggttcaccatctcccgcgacaattccaagaacacgctgtatctgcaaatgaacagcctgcgtgccgaggataccgcggtatattactgtgcgaaatcgacgacgcgtgcttatagtgattattttgactactggggtcagggaaccctggtcaccgtctcgagc

SEQ ID NO: 48 - DNA, 363 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgagaattatgatatgcattgggtccgccaggctccagggaagggtctagagtgggtctcagggattactacgcatggtaggcgtacatactacgcagactccgtgaagggccggttcaccatctcccgcgacaattccaagaacacgctgtatctgcaaatgaacagcctgcgtgccgaggataccgcggtatattactgtgcgaaaagtgataatttgaatatgaatgtggattttgactactggggtcagggaaccctggtcaccgtctcgagc

SEQ ID NO: 49 - DNA, 363 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttattaagtatgatatgtgttgggcccgccaggctccagggaagggtctagagtgggtctcatgtattgagtctagtggtcagaatacatactacgcagactccgtgaagggccggttcaccatctcccgcgacaattccaagaacacgctgtatctgcaaatgaacagcctgcgtgccgaggacaccgcggtatattactgtgcgaaatgtctgaatgatagttgtaatgttcattttgactactggggtcagggaaccctggtcaccgtctcgagc

SEQ ID NO: 50 - DNA, 363 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttggtaattataatatggggtgggtccgccaggctccagggaagggtctagagtgggtctcagatattggtcgttatggtagggttacatactacgcagactccgtgaagggccggttcaccatctcccgcgacaattccaagaacacgctgtatctgcaaatgaacagcctgcgtgccgaggataccgcggtatattactgtgcgaaaactcagcgtatggttaatccgtcgccttttgactactggggtcagggaaccctggtcaccgtctcgagc

SEQ ID NO: 51 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcttccggattcacctttgttagttatagtatgggttgggtccgccaggctccagggaagggtctagagtgggtctcaattatttcggggcagggtactgttacatactacgcagactccgtgaagggccggttcaccatctcccgcgacaattccaagaacacgctgtatctgcaaatgaacagcctgcgtgccgaggacaccgcggtatattactgtgcgaaatcgccgatggtttttgctttggatgggaggtcttttgactactggggtcagggaaccctggtcaccgtctcgagc

SEQ ID NO: 52 - DNA, 369 bp, Artificial Sequence
  Description of Artificial Sequence: Synthetic polynucleotide
gaggtgcagctgttggagtctgggggaggcttggtacagcctggggggtccctgcgtctctcctgtacagcctccggattcaccttttctgagtatagtatggggtgggtccgccaggctccagggaagggtctagagtgggtctcaagtattacgcctgttggtgtttttacatactacgcagactccgtgaagggccggttcaccatctcccgcgacaattccaagaacacgctgtatctgcaaatgaacagcctgcgtgccgaggacaccgcggtatattactgtgcgaaagggaggcctgggccgcatggttggtcttttcggtttgactactggggtcagggaaccctggtcaccgtctcgagc

SEQ ID NO: 53 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgggcagtatatgatgggttgggtccgccaggctccagggaagggtctagagtgggtctcaactattgataagtcgggttatagtacatactacgcagactccgtgaagggccggttcaccatctcccgcgacaattccaagaacacgctgtatctgcaaatgaacagcctgcgtgccgaggacaccgcggtatattactgtgcgaaaagtgggattgattcgcggggtctgatgactaagtttgactactggggtcagggaaccctggtcaccgtctcgagc

SEQ ID NO: 54 - DNA, 369 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttgctcgttatcgtatggcgtgggtccgccaggctccagggaagggtctagagtgggtctcatctattctgagtgatggtgcggttacatactacgcagactccgtgaagggccggttcaccatctcccgcgacaattccaagaacacgctgtatctgcaaatgaacagcctgcgtgccgaggacaccgcggtatattactgtgcgaaacctggggggaatgcgtggtctactcgggttacttttgactactggggtcagggaaccctggtcaccgtctcgagc

SEQ ID NO: 55 - DNA, 369 bp, Artificial Sequence
  Description of Artificial Sequence: Synthetic polynucleotide
  modified_base (99)..(99): a, c, g, t, unknown or other
gaggtgcagctgttggagtctgggggaggcttggtacagcctggggggtccctgcgtctctcctgtgcagcctccggattcaccttttttacgtatacnatggcttgggtccgccaggctccagggaagggtctagagtgggtctcatctattacgccgcttggttataatacatactacgcagactccgtgaagggccggttcaccatctcccgcgacaattccaagaacacgctgtatctgcaaatgaacagcctgcgtgccgaggacaccgcggtatattactgtgcgaaaccgtcggatgtgaaggtgtctccgctgccgagttttgactactggggtcggggaaccctggtcaccgtctcgagc

SEQ ID NO: 56 - DNA, 372 bp, Artificial Sequence
  Description of Artificial Sequence: Synthetic polynucleotide
gaggtgcagctgttggagtctgggggaggcttggtacagcctggggggtccctgcgtctctcctgtgcagcctccggattcacctttactatgtatggtatgcattgggtccgccaggctccagggaagggtctagagtgggtctcatcgatttctcagtatggtctttctacatactacgcagattccgtgaagggccggttcaccatctcccgcgacaattccaagaacacgctgtatctgcaaatgaacagcctgcgtgccgaggacaccgcggtatattactgtgcgaaagggtctatgaggcgggtgtttagtagttcggatacttttgactactggggtcagggaaccctggtcaccgtctcgagc

SEQ ID NO: 57 - DNA, 324 bp, Artificial Sequence
  Description of Artificial Sequence: Synthetic polynucleotide
gacatccagatgacccagtctccatcctccctgtctgcatctgtaggagaccgtgtcaccatcacttgccgggcaagtcagaatataggtgatcggttacattggtaccagcagaaaccagggaaagcccctaagctcctgatctatcgtatttcccgtttgcaaagtggggtcccatcacgtttcagtggcagtggatctgggacagatttcactctcaccatcagcagtctgcaacctgaagattttgctacgtactactgtcaacagtttgggctgtatcctactacgttcggccaagggaccaaggtggaaatcaaacgg

SEQ ID NO: 58 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSRLQSGVPSRFSGSGSGTDFTLTISSLQPEDFATYYCLQNVSMPATFSQGTKVEIKR

SEQ ID NO: 59 - protein, 108 aa, Artificial Sequence
  Description of Artificial Sequence: Synthetic polypeptide
DIQMTQSPSSLSASVGDRVTITCRASQYIGSALSWYQQKPGKAPKLLIYRASNLQSGVPSRFSGSGSGTDFTLTISSLQPEDFATYYCQQLAIRPFTFGQGTKVEIKR

SEQ ID NO: 60 - protein, 108 aa, Artificial Sequence
  Description of Artificial Sequence: Synthetic polypeptide
DIQMTQSPSSLSASVGDRVTITCRASRDIALDLLWYQQKPGKAPKLLIKGWSGLQSGVPSRFSGSGSGTDFTLTISSLQPEDFATYYCAQGWGRPVTFGQGTKVEIKR

SEQ ID NO: 61 - protein, 108 aa, Artificial Sequence
  Description of Artificial Sequence: Synthetic polypeptide
DIQMTQSPSSLSASVGDRVTITCRASQPIGHSLAWYQQKPGKAPKLLIYWASTLQSGVPSRFSGSGSGTDFTLTISSLQPEDFATYYCQQMLRTPFTFGQGTKVEIKR

SEQ ID NO: 62 - protein, 108 aa, Artificial Sequence
  Description of Artificial Sequence: Synthetic polypeptide
DIQMTQSPSSLSASVGDRVTITCRASQRIGSNLAWYQQKPGKAPKLLIYWASLLQSGVPSRFSGSGSGTDFTLTISSLQPEDFATYYCQQTRSAPFTFGQGTKVEIKR

SEQ ID NO: 63 - protein, 108 aa, Artificial Sequence
  Description of Artificial Sequence: Synthetic polypeptide
DIQMTQSPSSLSASVGDRVTITCRASQSIGHSLVWYQQKPGKAPKLLIYWASLLQSGVSSRFSGSGSGTDFTLTISSLQPEDFATYYCQQSRAAPFTFGQGTKVEIKR

SEQ ID NO: 64 - protein, 108 aa, Artificial Sequence
  Description of Artificial Sequence: Synthetic polypeptide
DIQMTQSPSSLSASVGDRVTITCRASQYIGTALNWYQQKPGKAPKLLIYRRSHLQSGVPSRFSGSGSGTDFTLTISSLQPEDFATYYCQQIALTPYTFGQGTKVEIKR

SEQ ID NO: 65 - protein, 108 aa, Artificial Sequence
  Description of Artificial Sequence: Synthetic polypeptide
DIQMTQSPSSLSASVGDRVTITCRASQPIGSVLAWYQQKPGKAPKLLIYFSSILQSGVPSRFSGSGSGTDFTLTISSLQPEDFATYYCQQALRSPFTFGQGTKVEIKR

SEQ ID NO: 66 - protein, 108 aa, Artificial Sequence
  Description of Artificial Sequence: Synthetic polypeptide
DIQMTQSPSSLSASVGDRVTITCRASQYIGTSLAWYQQKPGKAPKLLIYHSSGLQSGVPSRFSGSGSGTDFTLTISSLQPEDFATYYCQQTALRPFTFGQGTKVEIKR

SEQ ID NO: 67 - protein, 108 aa, Artificial Sequence
  Description of Artificial Sequence: Synthetic polypeptide
DIQMTQSPSSLSASVGDRVTITCRASQHINASLGWYQQKPGKAPKLLIYWASQLQSGVPSRFSGSGSGTDFTLTISSLQPEDFATYYCQQMVRTPFTFGQGTKVEIKR

SEQ ID NO: 68 - protein, 108 aa, Artificial Sequence
  Description of Artificial Sequence: Synthetic polypeptide
DIQMTQSPSSLSASVGDRVTITCRASQSIYPFLEWYQQKPGKAPKLLIYFTSRLQSGVPSRFSGSGSGTDFTLTISSLQPEDFATYYCQQNATNPATFGQGTKVEIKR

SEQ ID NO: 69 - protein, 108 aa, Artificial Sequence
  Description of Artificial Sequence: Synthetic polypeptide
DIQMTQSPSSLSASVGDRVTITCRASQYIGTSLNWYQQKPGKAPKLLTYQASFLQSGVPSRFSGSGSGTDFTLTISSLQPEDFATYYCQQLALRPMTFGQGTKVEIKR

SEQ ID NO: 70 - protein, 108 aa, Artificial Sequence
  Description of Artificial Sequence: Synthetic polypeptide
DIQMTQSPSSLSASVGDRVTITCRASQYIGTSLNWYQQKPGKAPKLLTYQASLLQSGVPSRFSGSGYGTDFTLTISSLQPEDFATYYCQQLALRPMTFGQGTKVEIKR

SEQ ID NO: 71 - protein, 108 aa, Artificial Sequence
  Description of Artificial Sequence: Synthetic polypeptide
DIQMTQSPSSLSASVGDRVTITCRASQYIGTSLNWYQQKPGKAPKLLTYRASLLQSGVPSRFSGSGSGTDFTLTISSLQPEDFATYYCQQLALRPMTFGQGTKVEIKR

SEQ ID NO: 72 - protein, 108 aa, Artificial Sequence
  Description of Artificial Sequence: Synthetic polypeptide
DIQLTQSPSSLSASVGDRVTITCRASQYIGTSLNWYQQKPGKAPKLLAYQASLLQSGVPSRFSGSGYGTDFTLTISSLQPEDFATYYCQQLALRPMTFGQGTKVEIKR

SEQ ID NO: 73 - protein, 108 aa, Artificial Sequence
  Description of Artificial Sequence: Synthetic polypeptide
DIQMTQSPSSLSASVGDRVTITCRASQYIGTSLNWYQQKPGKAPKLLTYQASLLQSGVPSRFSGSGSGTDFTLTISSLQPEDFATYYCQQLAMRPMTFGQGTKVEIKW

SEQ ID NO: 74 - protein, 108 aa, Artificial Sequence
  Description of Artificial Sequence: Synthetic polypeptide
DIQMTQSPSSLSASVGDRVTITCRASQYIGTSLNWYQQKPGKAPKLLIYQASLLQSGVPSRFSGSGYGTDFTLTISSLQPEDFATYYCQQLALRPMTFGQGTKVEIKR

SEQ ID NO: 75 - protein, 108 aa, Artificial Sequence
  Description of Artificial Sequence: Synthetic polypeptide
DIQMTQSPSSLSASVGDRVTITCRASQSISHSLVWYQQKPGKAPKLLIYWASLLQSGVPSRFSGSGSGTDFTLTISSLQPEDFATYYCQQGMSTPFTFGQGTKVEIKR

SEQ ID NO: 76 - protein, 108 aa, Artificial Sequence
  Description of Artificial Sequence: Synthetic polypeptide
DIQMTQSPSSLSASVGDRVTITCRASQSISHSLVWYQQKPGKAPKLLIYWASLLQSGVPSRFSGSGSGTDFTLTISSLQPEDFATYYCQQGMTAPFTFGQGTKVEIKR

SEQ ID NO: 77 - protein, 108 aa, Artificial Sequence
  Description of Artificial Sequence: Synthetic polypeptide
DIQMTQSPSSLSASVGDRVTITCRASQSIGYSLAWYQQKPGKAPKLLIYWVSSLQSGVPSRFSGSGSGTDFTLTISSLQPEDFATYYCQQTQRTPFTFGQGTKVEIKR

SEQ ID NO: 78 - protein, 108 aa, Artificial Sequence
  Description of Artificial Sequence: Synthetic polypeptide
DIQMTQSPSSLSASVGDRVTITCRASQNIGHGLAWYQQKPGKAPKLLIYWVSLLQSGVPSRFSGSGSGTDFTLTISSLQPEDFATYYCQQTLSKPFTFGQGTKVEIKR

SEQ ID NO: 79 - protein, 108 aa, Artificial Sequence
  Description of Artificial Sequence: Synthetic polypeptide
DIQMTQSPSSLSASVGDRVTITCRASSNIHNRLNWYQQKPGKAPKLLIYAASSLQSGVPSRFSGSGSGTDFTLTISSLQPEDFATYYCRQWIQPPWTFGQGTKVEIKR

SEQ ID NO: 80 - protein, 108 aa, Artificial Sequence
  Description of Artificial Sequence: Synthetic polypeptide
DIQMTQSPSSLSASVGDRVTITCRASQYIGTSLAWYQQKPGKAPKLLIYHSSGLQSGVPLRFSGSGSGTDFTLTISSLQPEDFATYYCQQTALRPFTFGQGTKVEIKR

SEQ ID NO: 81 - protein, 108 aa, Artificial Sequence; identical to SEQ ID NO: 59
  Description of Artificial Sequence: Synthetic polypeptide

SEQ ID NO: 82 - protein, 108 aa, Artificial Sequence
  Description of Artificial Sequence: Synthetic polypeptide
DIQMTQSPSSLSASVGDRVTITCRASQYIGSALGWYLQKPGKAPKLLIYRASNLQSGVPSRFSGSGYGTDFTLTISSLQPEDFATYYCQQLAIRPFTFGQGTKVEIKR

SEQ ID NO: 83 - protein, 108 aa, Artificial Sequence
  Description of Artificial Sequence: Synthetic polypeptide
DIQMTQSPSSLSASVGDRVTITCRASQYIGSALGWYQQKPGKAPKLLIYRASHLQSGVPSRFSGSGSGTDFTLTISSLQPEDFATYYCQQLAIRPFTFGQGTKVEIKR

SEQ ID NO: 84 - protein, 108 aa, Artificial Sequence
  Description of Artificial Sequence: Synthetic polypeptide
DIQMTQSPSSLSASVGDRVTITCRASQYIGSAISWYQQKPGRAPKLLIYRASYLQSGVPSRFSGSGSGTDFTLTISSLQPEDFATYYCQQLAIRPFTFGQGTKVGIKR

SEQ ID NO: 85 - protein, 108 aa, Artificial Sequence
  Description of Artificial Sequence: Synthetic polypeptide
DIQMTQSPSSLSASVGDRVTITCRASQYIGSALGWYQQKPGKAPKLLIYRASNLQSGVPSRFSGSGYGTGFTLTISSLQPEDFATYYCQQLAIRPFTFGQGTKVEIKR

SEQ ID NO: 86 - protein, 108 aa, Artificial Sequence
  Description of Artificial Sequence: Synthetic polypeptide
DIQMTQSPSSLSASVGDRVTITCRASQYIGSALGWYQQKPGKAPKLLIYRASNMQSGVPSRFSGSGSGTDFTLTISSLQPEDFATYYCQQLAIRPFTFGQGTKVEIKR

SEQ ID NO: 87 - protein, 108 aa, Artificial Sequence; identical to SEQ ID NO: 60
  Description of Artificial Sequence: Synthetic polypeptide

SEQ ID NO: 88 - protein, 108 aa, Artificial Sequence
  Description of Artificial Sequence: Synthetic polypeptide
DIQMTQSPSSLSASVGDRVTITCRASRDIALDILWYQQKPGKAPKLLIKGWSGLQSGVPSRFSGSGSGTDFTLTISSLQPEDFATYYCARGWGRPVTFGQGTKVEIKR

SEQ ID NO: 89 - protein, 108 aa, Artificial Sequence
  Description of Artificial Sequence: Synthetic polypeptide
DIQMTQSPSSLSASVGDRVTITCRASRDIALDILWYQQKPGKAPKLLIKGWSGLQSEVPSRFSGSGSGTDFTLTISSLQPEDFATYYCAKGWGRPVTFGQGTKVEIKR

SEQ ID NO: 90 - protein, 108 aa, Artificial Sequence
  Description of Artificial Sequence: Synthetic polypeptide
DIQMTQSPSSLSASVGDRVTITCRASRDIALDLMWYQQKPGKAPKLLIKGWSGLQSGVPSRFSGSGSGTDFTLTISSLQPEDFATYYCAQGWGRPVTFGQGTKVEIKR

SEQ ID NO: 91 - protein, 108 aa, Artificial Sequence
  Description of Artificial Sequence: Synthetic polypeptide
DIQMTQSPSSLSASVGDRVTITCRASRDIALDLSWYQHKPGKAPKLLIKGWSGLQSGVPSRFSGSGSGTDFTLTINSLQPEDFATYYCAQGWGRPVTFGQGTKVEIKR

SEQ ID NO: 92 - protein, 108 aa, Artificial Sequence
  Description of Artificial Sequence: Synthetic polypeptide
DIQMTQSPSSLSASVGDRVTITCRASRDIALDLSWYQQKPGRAPKLLIKGWSGLQSGVPSRFSGSGSGTDFTLTISSLQPEDFATYYCAQGWGRPETFGQGTKVEIKR

SEQ ID NO: 93 - protein, 108 aa, Artificial Sequence
  Description of Artificial Sequence: Synthetic polypeptide
DIQMTQSPSSLSASVGDRVTITCRASRDIALDLLWYQLKPGKAPKLLIKGWSGLQSGVPSRFSGSGSGTDFTLTISSLQPEDFATYFCAQGWGRPVTFGQGTKVEIKR

SEQ ID NO: 94 - protein, 108 aa, Artificial Sequence
  Description of Artificial Sequence: Synthetic polypeptide
DIQMTQSPSSLSASVGDRVTITCRASRDIALDLLWYQQKPGKAPKLLIKGWSGLQSGVPSRFSGSGSGTDFTLTISSLQPEDFATYYCAQGWGRPATFGQGTKVEIKR

SEQ ID NO: 95 - protein, 108 aa, Artificial Sequence
  Description of Artificial Sequence: Synthetic polypeptide
DIQMTQSPSSLSASVGDRVTITCRASQPIGSVLAWYQQKPGKAPKLLIYFSSILQSGVPSRFSGSGSGTDFTLTISGLQPEDFATYYCQQALRSPFTFGQGTKVEIKR

SEQ ID NO: 96 - protein, 108 aa, Artificial Sequence
  Description of Artificial Sequence: Synthetic polypeptide
DIQMTQSPSSLSASVGDRVTITCRASQYIGTALHWYQQKPGKAPRLLIYLSSNLQSGVPSRFSGSGSGTDFTLTISSLQPEDFATYYCQQSALNPYTFGQGTKVEIKR

SEQ ID NO: 97 - protein, 108 aa, Artificial Sequence
  Description of Artificial Sequence: Synthetic polypeptide
DIQMTQSPSSLSASVGDRVTITCRASQKIGTGLRWYQQKPGKAPKLLIYRASVLQSGVPSRFSGSGSGTDFTLTISSLQPEDFATYYCQQTAFPPYTFGQGTKVEIKR

SEQ ID NO: 98 - protein, 108 aa, Artificial Sequence
  Description of Artificial Sequence: Synthetic polypeptide
DIQMTQSPSSLSASVGDRVTITCRASQSIGTGLRWYQQKPGKAPMLLIYRASILQSGVPSRFSGGGSGTDFTLTISSLQPEDFATYYCQQTWYRPYTFGQGTKVEIKR

SEQ ID NO: 99 - protein, 108 aa, Artificial Sequence
  Description of Artificial Sequence: Synthetic polypeptide
DIQMTQSPSSLSASVGDRVTITCRASRDIGHMLNWYQQKPGKAPKLLIWFGSVLQSGVPSRFSGSGSGTDFTLTISSLQPEDFATYYCVQGRLRPPTFGQGTKVEIKR

SEQ ID NO: 100 - protein, 108 aa, Artificial Sequence
  Description of Artificial Sequence: Synthetic polypeptide
DIQMTQSPSSLSASVGDRVTITCRASRSINHWLDWYQQKPGKAPTLLISGVSWLQSGVPSRFSGSGSGTDFTLTISSLQPEDFATYYCCQPGFRPCTFGQGTKVEIKR

SEQ ID NO: 101 - protein, 108 aa, Artificial Sequence
  Description of Artificial Sequence: Synthetic polypeptide
DIQMTQSPSSLSASVGDRVTITCRASQYIGTQLSWYQQKPGKAPKLLIYRGSLLQSGVPSRFSGSGSGTDFTLTISSLQPEDFATYYCQQTALSPYTFGQGTKVEIKR

SEQ ID NO: 102 - protein, 108 aa, Artificial Sequence
  Description of Artificial Sequence: Synthetic polypeptide
DIQMTQSPSSLSASVGDRVTITCRASQYIGGALSWYQQKPGKAPKLLIYRASRLQSGVPSRFSGSGSGTDFTLTISSLQPEDFATYYCQQVALVPYTFGQGTKVEIKR

SEQ ID NO: 103 - protein, 108 aa, Artificial Sequence
  Description of Artificial Sequence: Synthetic polypeptide
DIQMTQSPSSLSASVGDRVTITCRASQYIGTRLSWYQQKPGKAPKLLIYNASFLQSGVPSRFSGSGSGTDFTLTISSLQPEDFATYYCQQLALSPLTFGQGTKVEIKR

SEQ ID NO: 104 - protein, 108 aa, Artificial Sequence
  Description of Artificial Sequence: Synthetic polypeptide
DIQMTQSPSSLSASVGDRVTITCRASQYIGTRLVWYQQKPGKAPKLLIYQSSLLQSGVPSRFRGSGSGTDFTLTISSLQPEDSATYYCQQTALVPYTFGQGTKVEIKR

SEQ ID NO: 105 - protein, 108 aa, Artificial Sequence
  Description of Artificial Sequence: Synthetic polypeptide
DIQMTQSPSSLSASVGDRVTITCRASQSIYPFLEWYQQKPGKAPRLLIYFTSRLQSGVPSRFSGSGSGTDFTLTISSLQPEDFATYYCQQSASMPITFGQGTKVEIKR

SEQ ID NO: 106 - protein, 108 aa, Artificial Sequence
  Description of Artificial Sequence: Synthetic polypeptide
DIQMTQSPSSLSASVGDRVTITCRASQNIGHMLAWYQQKPGKAPKLLIYWGSLLQSGVPSRFSGSGSGTDFTLTISSLQPEDFATYYCQQARAAPFTFGQGTKVEIKR

SEQ ID NO: 107 - protein, 108 aa, Artificial Sequence; identical to SEQ ID NO: 61
  Description of Artificial Sequence: Synthetic polypeptide

SEQ ID NO: 108 - protein, 108 aa, Artificial Sequence
  Description of Artificial Sequence: Synthetic polypeptide
DIQMTQSPSSLSASVGDRVTITCRASQPIGHSFGWYQQKPGKAPKLLIYWASTLQSGVPTRFSGSGSGTDFTLTISSLQPEDFATYYCQQMLRTPFTFGQGTKVEIKR

SEQ ID NO: 109 - protein, 108 aa, Artificial Sequence
  Description of Artificial Sequence: Synthetic polypeptide
DIQMTQSPSSLSASVGDRVTITCRASQPIGHSLGWYQQKPGKAPKLLFYWASTLQSGVPSRFSGSGSGTDFTLTISSLQPEDFATYYCQQMLRTPFTFGQGTKVEIKR

SEQ ID NO: 110 - protein, 108 aa, Artificial Sequence
  Description of Artificial Sequence: Synthetic polypeptide
DIQMTQSPSSLSASVGDRVTITCRASQPIGHSFGWYQQKPGKAPKLLIYWASTLQSGVPSRFSGSGSGTDFTLTISSLQPEDLATYYCQQMLRTPFTFGHGTKVEIKR

SEQ ID NO: 111 - protein, 108 aa, Artificial Sequence
  Description of Artificial Sequence: Synthetic polypeptide
DIQMTQSPSSLSASVGDRVTITCRASQPIGHSLGWYQQKPGKAPKLLIYWASTLQSGVPSRFSGSGSGTDFTITISSLQPEDFATYYCQQMLRTPFTFGQGTKVEIKR

SEQ ID NO: 112 - protein, 108 aa, Artificial Sequence
  Description of Artificial Sequence: Synthetic polypeptide
DIQMTQSPSSLSASVGDRVTITCRASQPIGHSLGWYQQKPGKAPKLLIYWGSWLQSGVPSRFSGSGSGTDFTLTISSLQPEDFATYYCQQMLRTPFTFGQGTKVEIKR

SEQ ID NO: 113 - protein, 108 aa, Artificial Sequence
  Description of Artificial Sequence: Synthetic polypeptide
DIQMTQSPSSLSASVGDRVTITCRASQPIGHSLGWYQQKPGKAPKLLIYWASVLLHGVPSRFSGSGSGTDFTLTISSLQPEDFATYYCQQMLRTPFTFGQGTKVEIKR

SEQ ID NO: 114 - protein, 108 aa, Artificial Sequence
  Description of Artificial Sequence: Synthetic polypeptide
DIQMTQSPSSLSASVGDRVTITCRASQPIGHSLGWYQQKPGKAPKLLIYWASLLLDGVPSRFSGSGSGTDFTLTISSLQPEDFATYYCQQMLRTPFTFGQGTKVEIKR

SEQ ID NO: 115 - protein, 108 aa, Artificial Sequence
  Description of Artificial Sequence: Synthetic polypeptide
DIQMTQSPSSLSASVGDRVAITCRASQPIGHSLGWYEQKPGKAPKLLIYWSSVLISGVPSRFSGSGSGTDFTLTISSLQPEDFATYYCQQMLRTPFTFGQGTKVEIKR

SEQ ID NO: 116 - protein, 108 aa, Artificial Sequence
  Description of Artificial Sequence: Synthetic polypeptide
DIQMTQSPSSLSASVGDRVTITCRASQPIGHSFAWYQQKPGKAPKLLIYWASTLQSGVPSRFSGSGSGTDFTLTISSLQPEDFATYFCQQMLRTPFTFGQGTKVEIKR

SEQ ID NO: 117 - protein, 108 aa, Artificial Sequence
  Description of Artificial Sequence: Synthetic polypeptide
DIQMTQSPSSLSASVGDRVTITCRASQPIGHSLAWYQQKPGKAPKLLIYWASTLQSGVPSRFSGSGSGTDFTLTISSLQPEDFATYYCQQMLRTPFAFGQGTKVEIKR

SEQ ID NO: 118 - protein, 108 aa, Artificial Sequence
  Description of Artificial Sequence: Synthetic polypeptide
DIQMTQSSSSLSASVGDRVSITCRASQPIGHSLGWYQQKPGKAPKLLIYWASTLQSGVPSRFSGSGSGTDFTLTISSLQPADSATYYCQQMLRTPFTFGQGTKVEIKR

SEQ ID NO: 119 - protein, 108 aa, Artificial Sequence
  Description of Artificial Sequence: Synthetic polypeptide
DIQMTQSPSSRSASVGDRVTITCRASQPIGHSLGWYQQKPGKAPKLLIYWASTLQSGVPSRFSGSGSGTDFTLTISSLQPEDFATYYCQQMLRTPFTFGQGTKVEIKR

SEQ ID NO: 120 - protein, 108 aa, Artificial Sequence
  Description of Artificial Sequence: Synthetic polypeptide
DTQMTQSPSSLSASVGDRVTITCRASRPIGHSLGWYQQKPGKAPKLLIYWASMLQSGVPSRFSGSGSGTDFTLTISSLQPEDFATYYCQQMLRTPFTFGQGTKVEIKR

SEQ ID NO: 121 - protein, 108 aa, Artificial Sequence
  Description of Artificial Sequence: Synthetic polypeptide
DIQMTQSPSSLSASVGDRVTVTCRASQPIGHSLAWYQQKPGKAPKLLIYWASMLQSGVPSRFSGSGSGTDFTLTISSLQPEDFATYYCQQMLRTPFTFGQGTKVEIKR

SEQ ID NO: 122 - protein, 108 aa, Artificial Sequence
  Description of Artificial Sequence: Synthetic polypeptide
DIQMTQSPSSLSASVGDRVTITCRASQPIGHSFAWYQQKPGKAPKLLIYWASTLQSGVPSRFSGSGSGTDFTLTISSLQPEDFATYYCQQMLRTPFTFGQGTKVEIKR

SEQ ID NO: 123 - protein, 108 aa, Artificial Sequence
  Description of Artificial Sequence: Synthetic polypeptide
DIQMTQSPSSLSASVGDRVTITCRASQPIGHSLAWYQQKPGKAPKLLIYWASMLQSGVPSRFSGSGSGTDFTLTISSLQPEDFATYYCQQMLRTPFSFGQGTKVEIKR

SEQ ID NO: 124 - protein, 108 aa, Artificial Sequence
  Description of Artificial Sequence: Synthetic polypeptide
DIQMTQSPSSLSASVGDRVTITCRASQPIGHSFAWYQQKPGKAPKLLIYWASTLQSGVPSRFSGSGSGTDFTLTISSLQPEDFATYYCQQMLRTPFMFGQGTKVEIKR

SEQ ID NO: 125 - protein, 108 aa, Artificial Sequence
  Description of Artificial Sequence: Synthetic polypeptide
DIQMTQSPSSLSASVGDRVTITCRASQPIGHSLGWYQQKPGKAPKLLIYWASTLQSGVPSRFSGSGSGTDFTLTISSLQPEDFATYYCQQMLRTPFAFGQGTKVEIKR

SEQ ID NO: 126 - protein, 108 aa, Artificial Sequence
  Description of Artificial Sequence: Synthetic polypeptide
DIQMTQSPSSLSASVGDRVTITCRASQPIGHSFAWYQQKPGKAPKLLIYWASTLQSGVPSRFSGSGSGTDFTLTISSLQPEDFATYYCQQMLRTPFAFGQGTKVEIKR

SEQ ID NO: 127 - protein, 108 aa, Artificial Sequence
  Description of Artificial Sequence: Synthetic polypeptide
DIQMTQSPSSLSASVGDRVTITCRASQPIGHSLGWYQQKPGKAPKLLIYWASMLQSGVPSRFSGSGSGTDFTLTISSLQPEDFATYYCQQMLRTPFSFGQGTKVEIKR

SEQ ID NO: 128 - protein, 108 aa, Artificial Sequence
  Description of Artificial Sequence: Synthetic polypeptide
DIQMTQSPSSLSASVGDRVTITCRASQPIGHSFAWYQQKPGKAPKLLIYWASMLQSGVPSRFSGSGSGTDFTLTISSLQPEDFATYYCQQMLRTPFSFGQGTKVEIKR

SEQ ID NO: 129 - protein, 108 aa, Artificial Sequence
  Description of Artificial Sequence: Synthetic polypeptide
DIQMTQSPSSLSASVGDRVTITCRASQPIGHSLGWYQQKPGKAPKLLIYWASMLQSGVPSRFSGSGSGTDFTLTISSLQPEDFATYYCQQMLRTPFMFGQGTKVEIKR

SEQ ID NO: 130 - protein, 108 aa, Artificial Sequence
  Description of Artificial Sequence: Synthetic polypeptide
DIQMTQSPSSLSASVGDRVTITCRASQPIGHSLGWYQQKPGKAPKLLIYWASMLQSGVPSRFSGSGSGTDFTLTISSLQPEDFATYYCQQMLRTPFAFGQGTKVEIKR

SEQ ID NO: 131 - protein, 108 aa, Artificial Sequence
  Description of Artificial Sequence: Synthetic polypeptide
DIQMTQSPSSLSASVGDRVTITCRASQPIGHSLGWYQQKPGKAPKLLIYWASTLQSGVPSRFSGSGSGTDFTLTISSLRPEDFATYYCQQMLRTPFTFGQGTKVEIKR

SEQ ID NO: 132 - protein, 108 aa, Artificial Sequence
  Description of Artificial Sequence: Synthetic polypeptide
DIQMTQSPSSLSASVGDRVTITCRASQPIGHSFGWYQQKPGKAPKLLIYWASMLQSGVPSRFSGSGSGTDFTLTISSLQPEDFATYYCQQMLRTPFSFGQGTKVEIKR

SEQ ID NO: 133 - protein, 108 aa, Artificial Sequence
  Description of Artificial Sequence: Synthetic polypeptide
DIQMTQSPSSLSASVGDRVTITCRASQPIGHSFGWYQQKPGKAPKLLIYWASMLQSGVPSRFSGSGSGTDFTLTISSLQPEDFATYYCQQMLRTPFMFGQGTKVEIKR

SEQ ID NO: 134 - protein, 108 aa, Artificial Sequence
  Description of Artificial Sequence: Synthetic polypeptide
DIQMTQSPSSLSASVGDRVTITCRASQPIGHSFGWYQQKPGKAPKLLIYWASMLQSGVPSRFSGSGSGTDFTLTISSLQPEDFATYYCQQMLRTPFAFGQGTKVEIKR

SEQ ID NO: 135 - protein, 108 aa, Artificial Sequence
  Description of Artificial Sequence: Synthetic polypeptide
DIQMTQSPSSLSASVGDRVTITCRASQPIGHSLGWYQQKPGKAPRLLIYWASTLQSGVPSRFSGSGSGTDFTLTISSLQPEDFATYYCQQMLRTPFTFGQGTKVEIKR

SEQ ID NO: 136 - protein, 108 aa, Artificial Sequence
  Description of Artificial Sequence: Synthetic polypeptide
DIQMTQSPSSLSASVGDRVTITCRASQPIGHSLGWYQQKPGKAPKLLIYWASTLQSGVPSRFSGSGSGTDFTLTISSLQPEDFATYYCQQMLRTPFTFGQGTKVENKR

SEQ ID NO: 137 - protein, 108 aa, Artificial Sequence
  Description of Artificial Sequence: Synthetic polypeptide
DIQMTQSPSSLSASVGDRVTITCRASQPIGHSFAWYQQKPGKAPKLLIYWASTLQSGVPSRFSGSGSGTDFTLTISSLQREDFATYYCQQMLRTPFTFGQGTKVEIKR

SEQ ID NO: 138 - protein, 108 aa, Artificial Sequence
  Description of Artificial Sequence: Synthetic polypeptide
DIQMTQSPSSLSASVGDRVTITCRASQPIGHSLGWYQQKPGKAPKLLTYWASTLQSGVPSRFSGSGSGTDFTLTISSLQPEDFATYYCQQMLRTPFTFGQGTKVEIKR

SEQ ID NO: 139 - protein, 108 aa, Artificial Sequence
  Description of Artificial Sequence: Synthetic polypeptide
DIQMTQSPSSLSASVGDRVTITCRASQPIGHSLGWYQQKPGKAPKLLIYWASTLQSGVPSRFSGSGSGTDFTLTISSLQPEDFATYYCQQMLRTPFMFGQGTKVEIKR

SEQ ID NO: 140 - protein, 108 aa, Artificial Sequence
  Description of Artificial Sequence: Synthetic polypeptide
DIQMTQSPSSLSASVGDRVTITCRASQPIGHSLGWYQQKPGKAPKLLIYWGSDLYKGVPSRFSGSGSGTDFTLTISSLQPEDFATYYCQQMLRTPFMFGQGTKVEIKR

SEQ ID NO: 141 - protein, 108 aa, Artificial Sequence
  Description of Artificial Sequence: Synthetic polypeptide
DIQMTQSPSSLSASVGDRVTITCRASTPIGHSLGWYQQKPGKAPKLLIYWASTLQSGVPSRFSGSGSGTDFTLTISSLQPEDFATYYCQQMLRTPFMFGQGTKVEIKR

SEQ ID NO: 142 - protein, 108 aa, Artificial Sequence
  Description of Artificial Sequence: Synthetic polypeptide
DIQMTQSPSSLSASVGDRVTITCRASQSIGHSLGWYQQKPGKAPKLLIYWASTLQSGVPSRFSGSGSGTDFTLTISSLQPEDFATYYCQQMLRTPFMFGQGTKVEIKR

SEQ ID NO: 143 - protein, 108 aa, Artificial Sequence
  Description of Artificial Sequence: Synthetic polypeptide
DIQMTQSPSSLSASVGDRVTITCRASKPISHSLGWYQQKPGKAPKLLIYWASTLQSGVPSRFSGSGSGTDFTLTISSLQPEDFATYYCQQMLRTPFMFGQGTKVEIKR

SEQ ID NO: 144 - protein, 108 aa, Artificial Sequence
  Description of Artificial Sequence: Synthetic polypeptide
DIQMTQSPSSLSASVGDRVTITCRASQAIDHSLGWYQQKPGKAPKLLIYWASTLQSGVPSRFSGSGSGTDFTLTISSLQPEDFATYYCQQMLRTPFMFGQGTKVEIKR

SEQ ID NO: 145 - protein, 108 aa, Artificial Sequence
  Description of Artificial Sequence: Synthetic polypeptide
DIQMTQSPSSLSASVGDRVTITCRASQPIGHSLGWYQQKPGKAPKLLIYWASMLQGGVPSRFSGSGSGTDFTLTISSLQPEDFATYYCQQMLRTPFMFGQGTKVEIKR

SEQ ID NO: 146 - protein, 108 aa, Artificial Sequence
  Description of Artificial Sequence: Synthetic polypeptide
DIQMTQSPSSLSASVGDRVTITCRASQPIGHTLGWYQQKPGKAPKLLIYWASDLIRGVPSRFSGSGSGTDFTLTISSLQPEDFATYYCQQMLRTPFMFGQGTKVEIKR

SEQ ID NO: 147 - protein, 108 aa, Artificial Sequence
  Description of Artificial Sequence: Synthetic polypeptide
DIQMTQSPSSLSASVGDRVTITCRASQPIGHALGWYQQKPGKAPRLLIYWASTLQSGVPSRFSGSGSGTDFTLTISSLQPEDFATYYCQQMLRTPFMFGQGTKVEIKR

SEQ ID NO: 148 - protein, 108 aa, Artificial Sequence
  Description of Artificial Sequence: Synthetic polypeptide
DIQMTQSPSSLSASVGDRVTITCRASQAIGHSLGWYQQKPGKAPKLLVYWASTLQSGVPSRFSGSGSGTDFTLTISSLQPEDFATYYCQQMLRTPFMFGQGTKVEIKR

SEQ ID NO: 149 - protein, 108 aa, Artificial Sequence
  Description of Artificial Sequence: Synthetic polypeptide
DIQMTQSPSSLSASVGDRVTITCRASQPIGHSLGWYQQKPGKAPKLLIYWGSDLSYGVPSRFSGSGSGTDFTLTISSLQPEDFATYYCQQMLRTPFMFGQGTKVEIKR

SEQ ID NO: 150 - protein, 108 aa, Artificial Sequence
  Description of Artificial Sequence: Synthetic polypeptide
DIQMTQSPSSLSASVGDRVTITCRASRSIGHSLGWYQQKPGKAPKLLIYWASTLQSGVPSRFSGSGSGTDFTLTISSLQPEDFATYYCQQMLRTPFMFGQGTKVEIKR

SEQ ID NO: 151 - protein, 108 aa, Artificial Sequence
  Description of Artificial Sequence: Synthetic polypeptide
DIQMTQSPSSLSASVGDRVTITCRASSTIGHSLGWYQQKPGKAPKLLIYWASTLQSGVPSRFSGSGSGTDFTLTISSLQPEDFATYYCQQMLRTPFMFGQGTKVEIKR

SEQ ID NO: 152 - protein, 108 aa, Artificial Sequence
  Description of Artificial Sequence: Synthetic polypeptide
DIQMTQSPSSLSASVGDRVTITCRASQPIGHSLGWYQQKPGKAPKLLIYWASTLQSGVPSRFSGSGSGTDFTLTISSLQPEDFATYYCQQMMRTPFMFGQGTKVEIKR

SEQ ID NO: 153 - protein, 108 aa, Artificial Sequence
  Description of Artificial Sequence: Synthetic polypeptide
DIQMTQSPSSLSASVGDRVTITCRASSRIGSSLGWYQQKPGKAPKLLIYWASMLQSGVPSRFSGSGSGTDFTLTISSLQPEDFATYYCQQMLRTPFMFGQGTKVEIKR

SEQ ID NO: 154 - protein, 108 aa, Artificial Sequence
  Description of Artificial Sequence: Synthetic polypeptide
DIQMTQSPSSLSASVGDRVTITCRASRAIGHSLGWYQQKPGKAPKLLIYWASTLQSGVPSRFSGSGSGTDFTLTISSLQPEDFATYYCQQMLRTPFMFGQGTKVEIKR

SEQ ID NO: 155 - protein, 108 aa, Artificial Sequence
  Description of Artificial Sequence: Synthetic polypeptide
DIQMTQSPSSLSASVGDRVTITCRASQPIGHSLGWYQQKPGKAPKLLIYWASTLQSGVPSRFSGSGSGTDFTLTISSLQPADFATYYCQQMLRTPFTFGRGTKVEIKR

SEQ ID NO: 156 - protein, 108 aa, Artificial Sequence; identical to SEQ ID NO: 62
  Description of Artificial Sequence: Synthetic polypeptide

SEQ ID NO: 157 - protein, 108 aa, Artificial Sequence
  Description of Artificial Sequence: Synthetic polypeptide
DIQMTQSPSSLSASVGDRVTITCRASQRIGSNLAWYQQKPGRAPKLLIYWASLLQSGVPSRFSGSGSGTDFTLIISSLQPEDFATYYCQQTRSAPFAFGQGTKVEIKR

SEQ ID NO: 158 - protein, 108 aa, Artificial Sequence
  Description of Artificial Sequence: Synthetic polypeptide
DLQMTQSPSSLSASVGDSVTITCRASQRIGSNLAWYQQKPGKAPKLLIYWASLLQSGVPSRFSGSGSGTDFTLTISSLQPEDFATYYCQQTRSAPFTFGQGTKVEIKR

SEQ ID NO: 159 - protein, 108 aa, Artificial Sequence
  Description of Artificial Sequence: Synthetic polypeptide
DFQMTQSPSSLSASVGDRVTITCRAGQRIGSNLAWYQQKPGKAPKLLIYWASLLQSGVPSRFSGSGSGTDFTLTISSLQPEDFATYYCQQTRSAPFTFGQGTKVEIKR

SEQ ID NO: 160 - protein, 108 aa, Artificial Sequence
  Description of Artificial Sequence: Synthetic polypeptide
DIQMTQSPSSLSASVGDRVTITCRASQRIGSNLAWYQQKPGKAPKLLVYWASLLQSGVPSRFSGSGSGTDFTLTISSLQPEDFATYYCQQTRSAPFTFGQGTKVEIKR

SEQ ID NO: 161 - protein, 108 aa, Artificial Sequence
  Description of Artificial Sequence: Synthetic polypeptide
DIQMTQSPSSLSASVGDRVTITCRASQRIGSNLAWYQQKPGKAPKLLIYWASLLQSGVPSRFSGSGSETDFTLTISSLQPEDFATYYCQQTRSAPFAFGQGTKVEIKR

SEQ ID NO: 162 - protein, 108 aa, Artificial Sequence
  Description of Artificial Sequence: Synthetic polypeptide
DIQMTQSPSSLSESIGDRVTITCRASQRIGSNLAWYQQKPGKAPKLLIYWASLLQNGVPSRFSGSGSGTDFTLTISSLQPEDFATYYCQQTRSAPFTFGQGTKVEIKR

SEQ ID NO: 163 - protein, 108 aa, Artificial Sequence
  Description of Artificial Sequence: Synthetic polypeptide
DIQMIQSPSSLSASVGERVTIICQASQRIGSNLAWYQQKPGKAPKLLIYWASLLQSGVPSRFSGSGSGSDFTLTISSLQPEDFATYYCQQTRSAPFTFGQGTKVEIKR

SEQ ID NO: 164 - protein, 108 aa, Artificial Sequence
  Description of Artificial Sequence: Synthetic polypeptide
DIQMTQSPSSLSASVGDRVTITCRASQRIGSNLAWYQQKPGKAPKLLIYWASLLQSGVPSRFSGSGSGTDFTLTINSLQPEDFATYYCQQTRSAPFTFGQGTKVEIKR

SEQ ID NO: 165 - protein, 108 aa, Artificial Sequence
  Description of Artificial Sequence: Synthetic polypeptide
DIQMTQSPSSLSASVGDRVTITCRASQGIGSNLAWYQQKPGKAPKLLIYWASLLQSGVPSRFSGSGSGTDFTLTISSLQPEDFATYYCQETRSAPFTFGQGTKVEIKR

SEQ ID NO: 166 - protein, 108 aa, Artificial Sequence
  Description of Artificial Sequence: Synthetic polypeptide
DIQMTQSPSSLSASVGDRVTITCRASQRIGSNLAWYQQKPGKAPKLLIYWASLLQSGVPSRFSGSGSGSDFTLTISSLQPEDFATYYCQETRSAPFTFGQGTKVEIKR

SEQ ID NO: 167 - protein, 108 aa, Artificial Sequence
  Description of Artificial Sequence: Synthetic polypeptide
DLQMTQSPSSLSASVGDRVTITCRASQRIGSNLAWYQQKPGKAPKLLIYWASLLQSGVPSRFSGSGSGTDFTLTISSLQPEDYATYYCQQTRSAPFTFGQGTKVEIKR

SEQ ID NO: 168 - protein, 108 aa, Artificial Sequence
  Description of Artificial Sequence: Synthetic polypeptide
DIQMTQSPSSLSASVGDRVTITCRASQRIGSNLAWYQQKPGKAPKLLIYWASLLQSGVPSRFSGSGSATDFTLTISSLRPEDFATYYCQQTRSAPFAFGQGTKVEIKR

SEQ ID NO: 169 - protein, 108 aa, Artificial Sequence
  Description of Artificial Sequence: Synthetic polypeptide
DIQMTQSPSSLSASVGDRVTITCRASQEIDHGLAWYQQKPGKAPKLLIYWASRLQSGVPSRFSGSGSGTDFTLTISSLQPEDFATYYCQQVVAAPFTFGQGTKVEIKR

SEQ ID NO: 170 - protein, 108 aa, Artificial Sequence
  Description of Artificial Sequence: Synthetic polypeptide
DIQMTQSPSSLSASVGDRVTITCRASQDIGLNLLWYQQKPGKAPTLLIYWSSMLQSGVPSRFSGSGSGTDFTLTISSLQPEDFATYYCQQGRMRPFTFGQGTKVEIKR

SEQ ID NO: 171 - protein, 108 aa, Artificial Sequence; identical to SEQ ID NO: 63
  Description of Artificial Sequence: Synthetic polypeptide

SEQ ID NO: 172 - protein, 108 aa, Artificial Sequence
  Description of Artificial Sequence: Synthetic polypeptide
DIQMTQSPSSLSASVGDRVTITCRASQSIGKGLMWYQQKPGKAPKLLIYWASMLQSGVPSRFSGSGSGTDFTLTISSLQPEDFATYYCQQSLRTPFTFGQGTEVEIKR

SEQ ID NO: 173 - protein, 108 aa, Artificial Sequence
  Description of Artificial Sequence: Synthetic polypeptide
DIQMTQSPSSLSASVGDRVTITCRASQPIGASLLWYQQKPGKAPRLLIYWGSLLQSGVPSRFSGSGSGTDFTLTISSLQPEDLATYYCQQSLRTPFTFGQGTKVEIKR

SEQ ID NO: 174 - protein, 108 aa, Artificial Sequence
  Description of Artificial Sequence: Synthetic polypeptide
DIQMTQSPSSLSASVGDRVTITCRASQDIGQSLVWYQQKPGKAPKLLIYWASMLQSGVPSRFSGSGSGTDFTLTISSLQPEDFATYYCQQVMRRPFTFGQGTKVEIKR

SEQ ID NO: 175 - protein, 108 aa, Artificial Sequence
  Description of Artificial Sequence: Synthetic polypeptide
DIQMTQSPSSLSASVGDRVTITCRASQSIGKSLAWYQQKPGKAPKLLIYWVSLLQSGVPSRFSGSGSGTDFTLTISSLQPEDFATYYCQQIVSRPFTFGQGTKVEIKR

SEQ ID NO: 176 - protein, 108 aa, Artificial Sequence
  Description of Artificial Sequence: Synthetic polypeptide
DIQMTQSPSSLSASVGDRVTITCRASQAISNGLLWYQQKPGKAPKLLIYWTSLLQSGVPSRFSGSGSGTDFTLTISSLQPEDFATYYCQQVLRRPFTFGQGTKVEIKR

SEQ ID NO: 177 - protein, 108 aa, Artificial Sequence
  Description of Artificial Sequence: Synthetic polypeptide
DIQMTQSPSSLSASVGDRVTITCRASQDIANSLVWYQQKPGKAPKLLIYWVSILQSGVPSRFSGSGSGTDFTLTISSLQPEDFATYYCQQTIAAPFTFGQGTKVEIKR

SEQ ID NO: 178 - protein, 108 aa, Artificial Sequence
  Description of Artificial Sequence: Synthetic polypeptide
DIQMTQSPSSLSASVGDRVTITCRASQTIGHGLVWYQQKPGKAPKLLIYWSSHLQSGVPSRFSGSGSGTDFTLTISSLQPEDFATYYCQQTLRTPFTFGQGTKVEIKR

SEQ ID NO: 179 - protein, 108 aa, Artificial Sequence
  Description of Artificial Sequence: Synthetic polypeptide
DIQMTQSPSSLSASVGDRVTITCRASQYIGNALAWYQQKPGKAPKLLIYRGSYLQSGVPSRFSGSGSRTDFTLTISSLQPEDFATYYCQQTALRPLTFGQGTKVEIKR

SEQ ID NO: 180 - protein, 108 aa, Artificial Sequence; identical to SEQ ID NO: 64
  Description of Artificial Sequence: Synthetic polypeptide

SEQ ID NO: 181 - protein, 108 aa, Artificial Sequence
  Description of Artificial Sequence: Synthetic polypeptide
DIQMTQSPSTLSASVGDRVTITCRASQYIGTALNWYQQKPGKAPKLLIYRGSHLQSGVPSRFSGSGSGTDFTLTISSLQPEDFATYYCQQIALTPYTFGQGTKVEIKR

SEQ ID NO: 182 - protein, 108 aa, Artificial Sequence
  Description of Artificial Sequence: Synthetic polypeptide
DIQMTQSPSSLSASVGDRVTITCRASQYIGTALNWYQQKPGKAPKLLIYRGSHLQSGVPSRFSGSGSGTDFTLTISSLQPEDFATYYCQQIALTPYTFGQGTKVEIKR

SEQ ID NO: 183 - protein, 108 aa, Artificial Sequence
  Description of Artificial Sequence: Synthetic polypeptide
DIQMTQSPSSLSASVGDRVTITCRASQYIGTALNWYQQKPGKAPKLLIYRGSHLLSGVPSRFSGSGSGTDFTLTISSLQPEDLATYYCQQIALTPYTFGQGTKVEIKR

SEQ ID NO: 184 - protein, 108 aa, Artificial Sequence
  Description of Artificial Sequence: Synthetic polypeptide
DIQMTQSPSSLSASVGDRVTITCRASQYIGTALNWYQQKPGEAPKLLIYRRSHLQSGVPSRFSGSGSETDFTLTISSLQPEDFVTYYCQQIALTPYTFGQGTKVEIKR

SEQ ID NO: 185 - protein, 108 aa, Artificial Sequence
  Description of Artificial Sequence: Synthetic polypeptide
DIQMTQSPSSLSASVGDRVTISCRASQYIGTALNWYQQKPGEAPKLLIYRRSHLQSGVPSRFSGSGSGTDFTLTISSLQPEDFATYYCQQIALTPFTFGQGTKVEIKR

SEQ ID NO: 186 - protein, 108 aa, Artificial Sequence
  Description of Artificial Sequence: Synthetic polypeptide
DIQMTQSPTSLSASVGDRVIITCRASQYIGTALNWYQQKPGKAPKLLIYRGSHLQSGVPSRFSGSGSGTDFTLTISSLQPEDFATYYCQQIALTPYTFGQGTKVEIKR

SEQ ID NO: 187 - protein, 108 aa, Artificial Sequence
  Description of Artificial Sequence: Synthetic polypeptide
DIQMTQSPSSLSASVGDRVTITCRASQYIGTALNWYQQKRGKAPELLIYRRSHLQSGVPSRFSGSGYGTDFTLTISSLQPEDFATYYCQQIALTPYTFSQGTKVEIKR

SEQ ID NO: 188 - protein, 108 aa, Artificial Sequence
  Description of Artificial Sequence: Synthetic polypeptide
DIQITQSPSSLSASVGDRVTITCRASQYIGTALNWYQQKPGKAPELLIYRGSHLQSGVPSRFSGSGSGTDFTLTISSLQPEDFVTYYCQQIALTPYTFGQGTKVEIKR

SEQ ID NO: 189 - protein, 108 aa, Artificial Sequence
  Description of Artificial Sequence: Synthetic polypeptide
DIQITQSPSSLSASVGDRVTFTCQASQYIGTALNWYQQKPGKAPKLLIYRGSHLQGGVPSRFSGSGSGTDFTLTISSLQLEDFATYYCQQIALTPYTFGQGTKVEIKR

SEQ ID NO: 190 - protein, 108 aa, Artificial Sequence
  Description of Artificial Sequence: Synthetic polypeptide
DIQMTQSPSSLSASVGDRVTITCQASQYIGTALNWYQQKPGKAPKLLIYRGSHLQSGVPSRFSGSGSGTDFTLTISSLQPEDFATYYCQQIALTPYTFGQGTKVEIER

SEQ ID NO: 191 - protein, 108 aa, Artificial Sequence
  Description of Artificial Sequence: Synthetic polypeptide
DIQMTQSPSSLSASVGDRVIITCRASQYIGTALNWYQQKPGNAPKLLIYRGSHLQSGVPSRFSGSGSGTDFTLTISSLLPEDYATYYCQQIALTPYTFSQGTKVEIKR

SEQ ID NO: 192 - protein, 108 aa, Artificial Sequence
  Description of Artificial Sequence: Synthetic polypeptide
DIQMTQSPSSLSASVGDRVTITCRASQYIGTALNWYQQKPGKAPKLLIYRGSHLQSGVPSRFSGSGSGTDFTLTISGLQPEDFATFYCQQIALTPYTFGQGTKVEIKR

SEQ ID NO: 193 - protein, 108 aa, Artificial Sequence
  Description of Artificial Sequence: Synthetic polypeptide
DIQMTQSPSSLSASVGDRVTITCRASQDIGASLLWYQQKPGKAPKLLIYFSSMLQSGVPSRFSGSGSGTDFTLTISSLQPEDFATYYCQQSGMRPFTFGQGTKVEIKR

SEQ ID NO: 194 - protein, 108 aa, Artificial Sequence; identical to SEQ ID NO: 99
  Description of Artificial Sequence: Synthetic polypeptide

SEQ ID NO: 195 - protein, 108 aa, Artificial Sequence
  Description of Artificial Sequence: Synthetic polypeptide
DIQMTQSPSSLSASVGDRVTITCRASRSIGHQLVWYQQKPGKAPKLLIAWSSVLQSGVPSRFSGSGSGTDFTLTISSLQPEDFATYYCRQDLSLPFTFGQGTKVEIKR

SEQ ID NO: 196 - protein, 108 aa, Artificial Sequence
  Description of Artificial Sequence: Synthetic polypeptide
DIQMTQSPSSLSASVGDRVTITCRASQSIYPFLEWYQQKPGKAPRLLIYFTSRLQSGVPSRFSGSGSGTDFTLTISSLQPEDFATYYCQQNATNPATFGQGTKVEIKR

SEQ ID NO: 197 - protein, 108 aa, Artificial Sequence
  Description of Artificial Sequence: Synthetic polypeptide
DIQMTQSPSSLSASVGDRVTITCRASRDIALDLLWYQQKPGKAPKLLIKGWSGLQSGVPSRFSGSGSGTDFTLTISSLQPEDFATYYCAQGWGRPVTFGQGTKVEIKC

SEQ ID NO: 198 - protein, 108 aa, Artificial Sequence
  Description of Artificial Sequence: Synthetic polypeptide
DIQMTQSPSSLSASVGDRVTITCRASQPIGSVLAWYQQKPGKAPKLLIYFSSILQSGVPSRFSGSGSGTDFTLTISGLQPEDFATYYCQQALRSPFTFGQGTKVEIKC

SEQ ID NO: 199 - protein, 108 aa, Artificial Sequence
  Description of Artificial Sequence: Synthetic polypeptide
DIQMTQSPSSLSASVGDRVTITCRASQPIGASLLWYQQKPGKAPRLLIYWGSLLQSGVPSRFSGSGSGTDFTLTISSLQPEDLATYYCQQSLRTPFTFGQGTKVEIKC

SEQ ID NO: 200 - protein, 108 aa, Artificial Sequence; identical to SEQ ID NO: 65
  Description of Artificial Sequence: Synthetic polypeptide

SEQ ID NO: 201 - protein, 108 aa, Artificial Sequence
  Description of Artificial Sequence: Synthetic polypeptide
DIQMTQSPSSLSASVGDRVTITCRASQPIGSVIAWYQQKPGKAPKLLIYFSSILQSGVPSRFSGSGSGTDFTLTISSLQPEDFATYYCQQALRSPFTFGQGTKVEIKR

SEQ ID NO: 202 - protein, 108 aa, Artificial Sequence
  Description of Artificial Sequence: Synthetic polypeptide
DIQMTQSPSSLSASVGDRVTITCRASQPIGSVLAWYQQKPGKAPKLLIYFSSILQRGVPSRFSGSGSGTDFTLTISSLQPEDFATYYCQQALRSPFTFGQGTKVEIKR

SEQ ID NO: 203 - protein, 108 aa, Artificial Sequence
  Description of Artificial Sequence: Synthetic polypeptide
DILMTQSPSSLSASVGDRVTITCRASQPIGSVLAWYQQKPGKAPKLLIYFSSILQRGVPSRFSGSGSGTDFTLTISSLQPEDFATYYCQQALRSPFTFGQGTKVEIKR

SEQ ID NO: 204 - protein, 108 aa, Artificial Sequence
  Description of Artificial Sequence: Synthetic polypeptide
DIQMTQSPSSLSASVGDRVTITCRASQYIGTRLVWYQQKPGKAPKLLIYQSSLLQSGVPSRFSGSGSGTDFTLTISSLQPEDSATYYCQQTALVPYTFGQGTKVEIKR

SEQ ID NO: 205 - protein, 108 aa, Artificial Sequence
  Description of Artificial Sequence: Synthetic polypeptide
DIQMTQSPSSLSASVGDRVTITCRASQPIGASLLWYQQKPGKAPRLLIYWGSLLQSGVPSRFSGSGSGTDFTLTISSLQPEDFATYYCQQSLRTPFTFGQGTKVEIKR

SEQ ID NO: 206 - protein, 108 aa, Artificial Sequence; identical to SEQ ID NO: 66
  Description of Artificial Sequence: Synthetic polypeptide

SEQ ID NO: 207 - protein, 108 aa, Artificial Sequence
  Description of Artificial Sequence: Synthetic polypeptide
DIQMTQSPSSLSASVGDRVTITCRASQYIGTALHWYQQKPGKAPKLLIYLSSNLQSGVPSRFSGSGSGTDFTLTISSLQPEDFATYYCQQSALNPYTFGQGTKVEIKR

SEQ ID NO: 208 - protein, 108 aa, Artificial Sequence
  Description of Artificial Sequence: Synthetic polypeptide
DIQMTQSPSSLSASVGDRVTITCRASQDIGLNLLWYQQKPGKAPKLLIYWSSMLQSGVPSRFSGSGSGTDFTLTISSLQPEDFATYYCQQGRMRPFTFGQGTKVEIKR

SEQ ID NO: 209 - protein, 108 aa, Artificial Sequence
  Description of Artificial Sequence: Synthetic polypeptide
DIQMTQSPSSLSASVGDRVTITCRASQSIGYSLAWYQQKPGKAPKLLIYWVSSLQSGVPSRFSGSGSGTDFTLTISSLQPEDFATYYCQQTQRTPFTFGQGTKVEIKC

SEQ ID NO: 210 - protein, 108 aa, Artificial Sequence
  Description of Artificial Sequence: Synthetic polypeptide
DIQMTQSPSSLSASVGDRVTITCRASQYIGSALSWYQQKPGKAPKLLIYRASNLQSGVPSRFSGSGSGTDFTLTISSLQPEDFATYYCQQLAIRPFTFGQGTKVEIKC

SEQ ID NO: 211 - protein, 108 aa, Artificial Sequence
  Description of Artificial Sequence: Synthetic polypeptide
DIQMTQSPSSLSASVGDRVTITCRASQYIGGALSWYQQKPGKAPKLLIYRASRLQSGVPSRFSGSGSGTDFTLTISSLQPEDFATYYCQQVALVPYTFGQGTKVEIKC

SEQ ID NO: 212 - protein, 108 aa, Artificial Sequence
  Description of Artificial Sequence: Synthetic polypeptide
DIQMTQSPSSLSASVGDRVTITCRASQRIGSNLAWYQQKPGKAPKLLIYWASLLQSGVPSRFSGSGSGTDFTLTISSLQPEDFATYYCQQTRSAPFTFGQGTKVEIKC

SEQ ID NO: 213 - protein, 108 aa, Artificial Sequence
  Description of Artificial Sequence: Synthetic polypeptide
DIQMTQSPSSLSASVGDRVTITCRASQPIGSVLAWYQQKPGKAPKLLIYFSSILQSGVPSRFSGSGSGTDFTLTISSLQPEDFATYYCQQALRSPFTFGQGTKVEIKC

SEQ ID NO: 214 - protein, 108 aa, Artificial Sequence
  Description of Artificial Sequence: Synthetic polypeptide
DIQMTQSPSSLSASVGDRVTITCRASQPIGASLLWYQQKPGKAPRLLIYWGSLLQSGVPSRFSGSGSGTDFTLTISSLQPEDFATYYCQQSLRTPFTFGQGTKVEIKC

SEQ ID NO: 215 - protein, 108 aa, Artificial Sequence
  Description of Artificial Sequence: Synthetic polypeptide
DIQMTQSPSSLSASVGDRVTITCRASQYIGTSLAWYQQKPGKAPKLLIYHSSGLQSGVPSRFSGSGSGTDFTLTISSLQPEDFATYYCQQTALRPFTFGQGTKVEIKC

SEQ ID NO: 216 - protein, 108 aa, Artificial Sequence
  Description of Artificial Sequence: Synthetic polypeptide
DIQMTQSPSSLSASVGDRVTITCRASQDIGLNLLWYQQKPGKAPKLLIYWSSMLQSGVPSRFSGSGSGTDFTLTISSLQPEDFATYYCQQGRMRPFTFGQGTKVEIKC

SEQ ID NO: 217 - protein, 108 aa, Artificial Sequence
  Description of Artificial Sequence: Synthetic polypeptide
DIQMTQSPSSLSASVGDRVTITCRASQPIGASLLWYQQKPGKAPKLLIYWGSLLQSGVPSRFSGSGSGTDFTLTISSLQPEDLATYYCQQSLRTPFTFGQGTKVEIKC

SEQ ID NO: 218 - protein, 108 aa, Artificial Sequence
  Description of Artificial Sequence: Synthetic polypeptide
DIQMTQSPSSLSASVGDRVTITCRASQYIGTRLVWYQQKPGKAPKLLIYQSSLLQSGVPSRFRGSGSGTDFTLTISSLQPEDFATYYCQQTALVPYTFGQGTKVEIKC

SEQ ID NO: 219 - protein, 108 aa, Artificial Sequence
  Description of Artificial Sequence: Synthetic polypeptide
DIQMTQSPSSLSASVGDRVTITCRASQSIGYSLAWYQQKPGKDPKLLIYWVSSLQSGVPSRFSGSGSGTDFTLTISSLQPEDFATYYCQQTQRTPFTFGQGTKVEIKR

SEQ ID NO: 220 - protein, 108 aa, Artificial Sequence
  Description of Artificial Sequence: Synthetic polypeptide
DIQMTQSPSSLSASVGDRVTITCRASQPIGSVLAWYQQKPGKDPKLLIYFSSILQSGVPSRFSGSGSGTDFTLTISGLQPEDFATYYCQQALRSPFTFGQGTKVEIKR

SEQ ID NO: 221 - protein, 108 aa, Artificial Sequence
  Description of Artificial Sequence: Synthetic polypeptide
DIQMTQSPSSLSASVGDRVTITCRASQYIGTRLVWYQQKPGKDPKLLIYQSSLLQSGVPSRFRGSGSGTDFTLTISSLQPEDSATYYCQQTALVPYTFGQGTKVEIKR

SEQ ID NO: 222 - protein, 108 aa, Artificial Sequence
  Description of Artificial Sequence: Synthetic polypeptide
DIQMTQSPSSLSASVGDRVTITCRASQPIGASLLWYQQKPGKDPKLLIYWGSLLQSGVPSRFSGSGSGTDFTLTISSLQPEDLATYYCQQSLRTPFTFGQGTKVEIKR

SEQ ID NO: 223 - protein, 108 aa, Artificial Sequence
  Description of Artificial Sequence: Synthetic polypeptide
DIQMTQSPSSLSASVGDRVTITCRASQTIGHGLVWYQQKPGKDPKLLIYWSSHLQSGVPSRFSGSGSGTDFTLTISSLQPEDFATYYCQQTLRTPFTFGQGTKVEIKR

SEQ ID NO: 224 - protein, 108 aa, Artificial Sequence
  Description of Artificial Sequence: Synthetic polypeptide
DIQMTQSPSSLSASVGDRVTITCRASQYIGTALNWYQQKPGKDPKLLIYRRSHLQSGVPSRFSGSGSGTDFTLTISSLQPEDFATYYCQQIALTPYTFGQGTKVEIKR

SEQ ID NO: 225 - protein, 108 aa, Artificial Sequence
  Description of Artificial Sequence: Synthetic polypeptide
DIQMTQSPSSLSASVGDRVTITCRASQHINASLGWYQQKPGKDPKLLIYWASQLQSGVPSRFSGSGSGTDFTLTISSLQPEDFATYYCQQMVRTPFTFGQGTKVEIKR

SEQ ID NO: 226 - protein, 108 aa, Artificial Sequence; identical to SEQ ID NO: 67
  Description of Artificial Sequence: Synthetic polypeptide

SEQ ID NO: 227 - protein, 108 aa, Artificial Sequence; identical to SEQ ID NO: 68
  Description of Artificial Sequence: Synthetic polypeptide

SEQ ID NO: 228 - protein, 108 aa, Artificial Sequence
  Description of Artificial Sequence: Synthetic polypeptide
DIQMTQSPSSLSASVGDRVTITCRASQSIYPFLEWYQQKPGKAPKLLIYFTSRLQSGVPSRFSGSGSGTDFTLTISSLQPEDFATYYCLQNVTNPATFSQGTKVEIKR

SEQ ID NO: 229 - protein, 108 aa, Artificial Sequence
  Description of Artificial Sequence: Synthetic polypeptide
DIQMTQSPSSLSASVGDRVTITCRASQSIYPFLEWYQQKPGKAPKLLIYFTSRLQSGVPSRFSGSGSGTDFTLTISSLQPEDFATYYCLQNVSMPATFSQGTKVEIKR

SEQ ID NO: 230 - protein, 108 aa, Artificial Sequence
  Description of Artificial Sequence: Synthetic polypeptide
DIQMTQSPSSLSASVGDRVTITCRASRAIWPFLEWYQQKPGKAPKLLIYFTSRLQSGVPSRFSGSGSGTDFTLTISSLQPEDFATYYCLQNVTNPATFSQGTKVEIKR

SEQ ID NO: 231 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSRLQSGVPSRFSGSGSGTDFTLTISSLQPEDFATYYCLQNVTNPATFSQGTKVEIKR

SEQ ID NO: 232 - protein, 108 aa, Artificial Sequence
  Description of Artificial Sequence: Synthetic polypeptide
DIQMTQSPSSLSASVGDRVTITCRASQPIWPFLEWYQQKPGKAPKLLIYFTSRLQSGVPSRFSGSGSGTDFTLTISSLQPEDFATYYCLQNVTNPATFSQGTKVEIKR

SEQ ID NO: 233 - protein, 108 aa, Artificial Sequence
  Description of Artificial Sequence: Synthetic polypeptide
DIQMTQSPSSLSASVGDRVTITCRASRTIYPFLEWYQQKPGKAPKLLIYFTSRLQSGVPSRFSGSGSGTDFTLTISSLQPEDFATYYCLQNVTNPATFSQGTKVEIKR

SEQ ID NO: 234 - protein, 108 aa, Artificial Sequence
  Description of Artificial Sequence: Synthetic polypeptide
DIQMTQSPSSLSASVGDRVTITCRASKPIYPFLEWYQQKPGKAPKLLIYFTSRLQSGVPSRFSGSGSGTDFTLTISSLQPEDFATYYCLQNVTNPATFSQGTKVEIKR

SEQ ID NO: 235 - protein, 108 aa, Artificial Sequence
  Description of Artificial Sequence: Synthetic polypeptide
DIQMTQSPSSLSASVGDRVTITCRASQAIWPFLEWYQQKPGKAPKLLIYFTSRLQSGVPSRFSGSGSGTDFTLTISSLQPEDFATYYCLQNVTNPATFSQGTKVEIKR

SEQ ID NO: 236 - protein, 108 aa, Artificial Sequence
  Description of Artificial Sequence: Synthetic polypeptide
DIQMTQSPSSLSASVGDRVTITCRASQSIYPFLEWYQQKPGKAPKLLIYFTSRLRQGVPSRFSGSGSGTDFTLTISSLQPEDFATYYCLQNVTNPATFSQGTKVEIKR

SEQ ID NO: 237 - protein, 108 aa, Artificial Sequence
  Description of Artificial Sequence: Synthetic polypeptide
DIQMTQSPSSLSASVGDRVTITCRASQSIYPFLEWYQQKPGKAPKLLIYFTSRLREGVPSRFSGSGSGTDFTLTISSLQPEDFATYYCLQNVTNPATFSQGTKVEIKR

SEQ ID NO: 238 - protein, 108 aa, Artificial Sequence
  Description of Artificial Sequence: Synthetic polypeptide
DIQMTQSPSSLSASVGDRVTITCRASQSIYPFLEWYQQKPGKAPKLLIYFSSRLASGVPSRFSGSGSGTDFTLTISSLQPEDFATYYCLQNVTNPATFSQGTKVEIKR

SEQ ID NO: 239 - protein, 108 aa, Artificial Sequence
  Description of Artificial Sequence: Synthetic polypeptide
DIQMTQSPSSLSASVGDRVTITCRASQSIYPFLEWYQQKPGKAPKLLIYFTSYLREGVPSRFSGSGSGTDFTLTISSLQPEDFATYYCLQNVTNPATFSQGTKVEIKR

SEQ ID NO: 240 - protein, 108 aa, Artificial Sequence
  Description of Artificial Sequence: Synthetic polypeptide
DIQMTQSPSSLSASVGDRVTITCRASQSIYPFLEWYQQKPGKAPKLLIYFTSRLRAGVPSRFSGSGSGTDFTLTISSLQPEDFATYYCLQNVTNPATFSQGTKVEIKR

SEQ ID NO: 241 - protein, 108 aa, Artificial Sequence
  Description of Artificial Sequence: Synthetic polypeptide
DIQMTQSPSSLSASVGDRVTITCRASQSIYPFLEWYQQKPGKAPKLLIYFTSRLASGVPSRFSGSGSGTDFTLTISSLQPEDFATYYCLQNVTNPATFSQGTKVEIKR

SEQ ID NO: 242 - protein, 108 aa, Artificial Sequence
  Description of Artificial Sequence: Synthetic polypeptide
DIQMTQSPSSLSASVGDRVTITCQASQSIYPFLEWYQQKPGKAPKLLIYFTSRLARGVPSRFSGSGSGTDFTLTISSLQPEDFATYYCLQNVTNPATFSQGTRVEIKR

SEQ ID NO: 243 - protein, 108 aa, Artificial Sequence
  Description of Artificial Sequence: Synthetic polypeptide
DIQMTQSPSSLSASVGDRVTITCRASQSIYPFLEWYQQKPGKAPKLLIYFASRLASGVPSRFSGSGSGTDFTLTISSLQPEDFATYYCLQNVTNPATFSQGTKVEIKR

SEQ ID NO: 244 - protein, 108 aa, Artificial Sequence
  Description of Artificial Sequence: Synthetic polypeptide
DIQMTQSPSSLSASVGDRVTITCRASQSIYPFLEWYQQKPGKAPKLLIYFTSRLAYGVPSRFSGSGSGTDFTLTISSLQPEDFATYYCLQNVTNPATFSQGTKVEIRR

SEQ ID NO: 245 - protein, 108 aa, Artificial Sequence
  Description of Artificial Sequence: Synthetic polypeptide
DIQMTQSPSSLSASVGDRVTITCRASQSIYPFLEWYQQKPGKAPKLLIYFTSKLTRGVPSRFSGSGSGADFTLTISNLQPEDFATYYCLQNVTNPATFSQGTKVEIKR

SEQ ID NO: 246 - protein, 108 aa, Artificial Sequence; identical to SEQ ID NO: 58
  Description of Artificial Sequence: Synthetic polypeptide

SEQ ID NO: 247 - protein, 108 aa, Artificial Sequence
  Description of Artificial Sequence: Synthetic polypeptide
DIQMTQSPSSLSASVGDRVTITCRASRNIYPFLEWYQQKPGKAPKLLIYFTSRLQSGVPSRFSGSGSGTDFTLTISSLQPEDFATYYCLQNVTNPATFSQGTKVEIKR

SEQ ID NO: 248 - protein, 108 aa, Artificial Sequence
  Description of Artificial Sequence: Synthetic polypeptide
DIQMTQSPSSLSASVGDRVTITCRASQSIYPFLEWYQQKPGKAPKLLIYFTSRLRHGVPSRFSGSGSGTDFTLTISSLQPEDFATYYCLQNVTNPATFSQGTKVEIKR

SEQ ID NO: 249 - protein, 108 aa, Artificial Sequence
  Description of Artificial Sequence: Synthetic polypeptide
DIQMTQSPSSLSASVGDRVTITCRASQSIYPFLEWYQQKPGKAPKLLIYFTSRLAAGVPSRFSGSGSGTDFTLTISSLQPEDFATYYCLQNVTNPAAFSQGTKVEIKR

SEQ ID NO: 250 - protein, 108 aa, Artificial Sequence
  Description of Artificial Sequence: Synthetic polypeptide
DIQMTQSPSSLSASVGDRVTITCRASQSIYPFLEWYQQKPGKAPKLLIYFSSMLASGVPSRFSGSGSGTDFTLTISSLQPEDFATYYCLQNVTNPATFSQGTKVEIKR

SEQ ID NO: 251 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSRLRAGVPSRFSGSGSGTDFTLTISSLQPEDFATYYCQQNVSMPATFSQGTKVEIKR

SEQ ID NO: 252 - protein, 108 aa, Artificial Sequence
  Description of Artificial Sequence: Synthetic polypeptide
DIQMTQSPSSLSASVGDRVTITCRASRAIWPFLEWYQQKPGKAPKLLIYFTSRLAYGVPSRFSGSGSGTDFTLTISSLQPEDFATYYCQQNVSMPATFSQGTKVEIKR

SEQ ID NO: 253 - protein, 108 aa, Artificial Sequence
  Description of Artificial Sequence: Synthetic polypeptide
DIQMTQSPSSLSASVGDRVTITCRASRAIWPFLEWYQQKPGKAPKLLIYFTSRLRQGVPSRFSGSGSGTDFTLTISSLQPEDFATYYCQQNVSMPATFSQGTKVEIKR

SEQ ID NO: 254 - protein, 108 aa, Artificial Sequence
  Description of Artificial Sequence: Synthetic polypeptide
DIQMTQSPSSLSASVGDRVTITCRASRAIWPFLEWYQQKPGKAPKLLIYFTSRLRAGVPSRFSGSGSGTDFTLTISSLQPEDFATYYCQQNVSMPATFSQGTKVEIKR

SEQ ID NO: 255 - protein, 108 aa, Artificial Sequence
  Description of Artificial Sequence: Synthetic polypeptide
DIQMTQSPSSLSASVGDRVTITCRASQSIYPFLEWYQQKPGKAPKLLIYFTSRLQSGVPSRFSGSGSGTDFTLTISSLQPEDFATYYCLQNVQMPATFSQGTKVEIKR

SEQ ID NO: 256 - protein, 108 aa, Artificial Sequence
  Description of Artificial Sequence: Synthetic polypeptide
DIQMTQSPSSLSASVGDRVTITCRASQSIYPFLEWYQQKPGKAPKLLIYFTSRLQSGVPSRFSGSGSGTDFTLTISSLQPEDFATYYCLQNVMMPATFSQGTKVEIKR

SEQ ID NO: 257 - protein, 108 aa, Artificial Sequence
  Description of Artificial Sequence: Synthetic polypeptide
DIQMTQSPSSLSASVGDRVTITCRASQSIYPFLEWYQQKPGKAPKLLIYFTSRLQSGVPSRFSGSGSGTDFTLTISSLQPEDFATYYCLQNVANPATFSQGTKVEIKR

SEQ ID NO: 258 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSRLRAGVPSRFSGSGSGTDFTLTISSLQPEDFATYYCLQNVSMPATFSQGTKVEIKR

SEQ ID NO: 259 - protein, 108 aa, Artificial Sequence
  Description of Artificial Sequence: Synthetic polypeptide
DIQMTQSPSSLSASVGDRVTITCRASRAIWPFLEWYQQKPGKAPKLLIYFTSRLAYGVPSRFSGSGSGTDFTLTISSLQPEDFATYYCLQNVSMPATFSQGTKVEIKR

SEQ ID NO: 260 - protein, 108 aa, Artificial Sequence
  Description of Artificial Sequence: Synthetic polypeptide
DIQMTQSPSSLSASVGDRVTITCRASRAIWPFLEWYQQKPGKAPKLLIYFTSRLRQGVPSRFSGSGSGTDFTLTISSLQPEDFATYYCLQNVSMPATFSQGTKVEIKR

SEQ ID NO: 261 - protein, 108 aa, Artificial Sequence
  Description of Artificial Sequence: Synthetic polypeptide
DIQMTQSPSSLSASVGDRVTITCRASRAIWPFLEWYQQKPGKAPKLLIYFTSRLRAGVPSRFSGSGSGTDFTLTISSLQPEDFATYYCLQNVSMPATFSQGTKVEIKR

SEQ ID NO: 262 - protein, 108 aa, Artificial Sequence
  Description of Artificial Sequence: Synthetic polypeptide
DIQMTQSPSSLSASVGDRVTITCRASQSIYPFLEWYQQKPGKAPKLLIYFTSRLRHGVPSRFSGSGSGTDFTLTISSLQPEDFATYYCLQNVSMPATFSQGTKVEIKR

SEQ ID NO: 263 - protein, 108 aa, Artificial Sequence
  Description of Artificial Sequence: Synthetic polypeptide
DIQMTQSPSSLSASVGDRVTITCRASQSIYPFLEWYQQKPGKAPKLLIYFTSRLAAGVPSRFSGSGSGTDFTLTISSLQPEDFATYYCLQNVSMPATFSQGTKVEIKR

SEQ ID NO: 264 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSRLRHGVPSRFSGSGSGTDFTLTISSLQPEDFATYYCLQNVTNPATFSQGTKVEIKR

SEQ ID NO: 265 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSRLAAGVPSRFSGSGSGTDFTLTISSLQPEDFATYYCLQNVTNPAAFSQGTKVEIKR

SEQ ID NO: 266 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSRLARGVPSRFSGSGSGTDFTLTISSLQPEDFATYYCLQNVTNPATFSQGTRVEIKR

SEQ ID NO: 267 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSRLRHGVPSRFSGSGSGTDFTLTISSLQPEDFATYYCLQNVSMPATFSQGTKVEIKR

SEQ ID NO: 268 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSRLAAGVPSRFSGSGSGTDFTLTISSLQPEDFATYYCLQNVSMPATFSQGTKVEIKR

SEQ ID NO: 269 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSRLQSGVPSRFSGSGSGTDFTLTISSLQPEDFATYYCLQNVQMPATFSQGTKVEIKR

SEQ ID NO: 270 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSRLQSGVPSRFSGSGSGTDFTLTISSLQPEDFATYYCLQNVANPATFSQGTKVEIKR

SEQ ID NO: 271 - protein, 108 aa, Artificial Sequence
  Description of Artificial Sequence: Synthetic polypeptide
DIQMTQSPSSLSASVGDRVTITCRASQSIYPFLEWYQQKPGKAPKLLIYFTSRLQSGVPSRFSGSGSGTDFTLTISSLQPEDFATYYCLQNVTNPATFGQGTKVEIKR

SEQ ID NO: 272 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEAPGVQTFYADSVRGRFTISRDNSKNTLYLQMNSLRAEDTAVYYCARSPFGPLYGFDYRGQGTLVTVSS

SEQ ID NO: 273 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEASGVQTFYADSVKGRFTISRDNSKNTLYLQMNSLRAEDTAVYYCAKSPFGPLYGFDYRGQGTLVTVSS

SEQ ID NO: 274 - protein, 121 aa, Artificial Sequence
  Description of Artificial Sequence: Synthetic polypeptide
EVQLLESGGGLVQPGGSLRLSCAASGFTFGTYKMVWVRQAPGKGLEWVSSIGPGGLDTYYADSVKGRFTISRDNSKNTLYLQMNSLRAEDTAVYYCAKSWMTLPITGFDYRGQGTLVTVSS

SEQ ID NO: 275 - protein, 121 aa, Artificial Sequence
  Description of Artificial Sequence: Synthetic polypeptide
EVQLLESGGGLVQPGGSLRLSCAASGFTFPLYEMAWVRQAPGKGLEWVSSIMSNGIRTYYADSVKGRFTISRDNSKNTLYLQMNSLRAEDTAVYYCAKRKSSSSRTVFDYWGQGTLVTVSS

SEQ ID NO: 276 - protein, 120 aa, Artificial Sequence
  Description of Artificial Sequence: Synthetic polypeptide
EVQLLESGGGLVQPGGSLRLSCAASGFTFDSANMTWVRQAPGKGLEWVSWIDDTGTQTYYADSVKGRFTISRDNSKNTLYLQMNSLRAEDTAVYYCAKSPFGPLYGFDYWGQGTLVTVSS

SEQ ID NO: 277 - protein, 116 aa, Artificial Sequence
  Description of Artificial Sequence: Synthetic polypeptide
EVQLLESGGGWVQPGGSLRLSCAASGFTFSRYHMAWVRQAPGKGLEWVSVIDSLGLQAYYADSVKGRFTISRDNSKNTLYLQMNSMRAEDTAVYYCAEYSGAFDYWGQGTLVTVSS

SEQ ID NO: 278 - protein, 116 aa, Artificial Sequence
  Description of Artificial Sequence: Synthetic polypeptide
EVQLLESGGGLVQPGGSLHLSCAASGFTFTRYHMAWVRQAPGKGLEWVSVIDSLGLQTYYADSVKGRFTISRDNSKNTLYLQMNSLRAEDTAVYYCAEYGGAFDYWGQGTLVTVSS

SEQ ID NO: 279 - protein, 116 aa, Artificial Sequence
  Description of Artificial Sequence: Synthetic polypeptide
EVQLLESGGGLVQPGGSLRLSCAASGFTFSRYHMAWVRQAPGKGLEWVSVIDSLGLQTYYADSVKGRFTISRDNSKNTLYLQMNSLRAEDTAVYYCAEYSGAFDYWGQGTLVTVSS

SEQ ID NO: 280 - protein, 116 aa, Artificial Sequence
  Description of Artificial Sequence: Synthetic polypeptide
EVQLLESGGGLVQPGGSLRLSCAASGFTFSRYHMAWVRQAPGKGLEWVSVIDSLGLQTYYADSVKGRFTISRDNSKNTLYLQMNSLRAEDTAVYYCAEYGGAFDYWGPGTLVTVSS

SEQ ID NO: 281 - protein, 117 aa, Artificial Sequence
  Description of Artificial Sequence: Synthetic polypeptide
EVQLLESGGGLVQPGGSLRLSCAASGFTFEDYDMNWVRQAPGKGLEWVSHIDRGGTLTYYADSVKGRFTISRDNSKNTLYLQMNSLRAEDTAVYYCAKSTLMGFDYWGQGTLVTVSS

SEQ ID NO: 282 - protein, 116 aa, Artificial Sequence
  Description of Artificial Sequence: Synthetic polypeptide
EVQLLESGGGLVQPGGSLRLSCAASGFTFAHYHMGWVRQAPGKGLEWVSWIPADGLRTYYADSVKGRFTISRDNSKNTLYLQMNSLRAEDTAVYYCAKYEGAFDYWGQGTLVTVSS

SEQ ID NO: 283 - protein, 121 aa, Artificial Sequence; identical to SEQ ID NO: 274
  Description of Artificial Sequence: Synthetic polypeptide

SEQ ID NO: 284 - protein, 117 aa, Artificial Sequence
  Description of Artificial Sequence: Synthetic polypeptide
EVQLLESGGGLVQPGGSLRLSCAASGFTFKTYTMRWVRQAPGKGLEWVSTINSSGTLTYYADSVKGRFTISRDNSKNTLYLQMNSLRAEDTAVYYCAKSSSYTFDYWGQGTLVTVSS

SEQ ID NO: 285 - protein, 117 aa, Artificial Sequence
  Description of Artificial Sequence: Synthetic polypeptide
EVQLLESGGGLVQPGGSLRLSCAASGFTFWFYDMQWVRQAPGKGLEWVSSITHNGKTTYYADSVKGRFTISRDNSKNTLYLQMNSLRAEDTAVYYCAKDGQLTFDYWGQGTLVTVSS

SEQ ID NO: 286 - protein, 123 aa, Artificial Sequence
  Description of Artificial Sequence: Synthetic polypeptide
EVQLLESGGGLVQPGGSLRLSCAASGFTFELYQMGWVRQAPGKGLEWVSTIMPSGNLTYYADSVKGRFTISRDNSKNTLYLQMNSLRAEDTAVYYCAKMWSLNLGFHAAFDYWGQGTLVTVSS

SEQ ID NO: 287 - protein, 121 aa, Artificial Sequence; identical to SEQ ID NO: 275
  Description of Artificial Sequence: Synthetic polypeptide

SEQ ID NO: 288 - protein, 121 aa, Artificial Sequence
  Description of Artificial Sequence: Synthetic polypeptide
EVQLLESGGGLVQPGGSLRLSCAASGFTFPLYEMAWVRQAPGKGLEWVSSIMSNGTRTYYADSVKGRFTISRDNSKNTLYLQMNSLRAEDTAVYYCAKRESSSSRTVFDYWGQGTLVTVSS

SEQ ID NO: 289 - protein, 121 aa, Artificial Sequence
  Description of Artificial Sequence: Synthetic polypeptide
EVQLLESGGGLVQPGGSLRLSCAASGFTFPLYEMAWVRQAPGKGLEWVSSIMSNGIRTYYADSVKGRFTISRDNSKNTLYLQMNSLRAEDTAVYYCAKRESSSSRTVFDYWGQGTLVTVSS

SEQ ID NO: 290 - protein, 121 aa, Artificial Sequence
  Description of Artificial Sequence: Synthetic polypeptide
EVQLLESGGGLVQPGGSLRLSCAASGFTFSVSEMAWVRQAPGKGLEWVSSIMSNGIRTYYADSVKGRFTISRDNSKNTLYLQMNSLRAEDTAVYYCARRESSSSRTVFDYWGQGTLVTVSS

SEQ ID NO: 291 - protein, 121 aa, Artificial Sequence
  Description of Artificial Sequence: Synthetic polypeptide
EVQLLESGGGLVQPGGSLRLSCAASGFTFYTAEMAWVRQAPGKGLEWVSSIMSNGIRTYYADSVKGRFTISRDNSKNTLYLQMNSLRAEDTAVYYCARRESSSSRTVFDYWGQGTLVTVSS

SEQ ID NO: 292 - protein, 121 aa, Artificial Sequence
  Description of Artificial Sequence: Synthetic polypeptide
EVQLLESGGGLVQPGGSLRLSCAASGFTFPGYTMEWVRQAPGKGLEWVSSITPLGANTYYADSVKGRFTISRDNSRNTLYLQMNSLRAEDTAVYYCAKDIRYTGTYNFDYWGQGTLVTVSS

SEQ ID NO: 293 - protein, 120 aa, Artificial Sequence
  Description of Artificial Sequence: Synthetic polypeptide
EVQLLESGGGLVQPGGSLRLSCAASGFTFPTYAMGWVRQAPGKGLEWVSFIPGAGGVTYYADSVKGRFTISRDNSKNTLYLQMNSLRAEDTAVYYCAKAVDGLANAFDYWGQGTLVTVSS

SEQ ID NO: 294 - protein, 116 aa, Artificial Sequence
  Description of Artificial Sequence: Synthetic polypeptide
EVQLLESGGGLVQPGGSLRLSCAASGFTFSSYAMIWVRQAPGKGLEWVSEISPYGNHTYYADSVKGRFTISRDNSKNTLYLQMNSLRAEDTAVYYCAKPDRRFDYWGQGTLVTVSS

SEQ ID NO: 295 - protein, 120 aa, Artificial Sequence
  Description of Artificial Sequence: Synthetic polypeptide
EVQLLESGGGLVQPGGSLRLSCAASGFTFHSYHMTWVRQAPGKGLEWVSWIDAHGFTTYYADSVKGRFTISRDNSKNTLYLQMNSLRAEDTAVYYCAKSRGGPLSTFDYWGQGTLVTVSS

SEQ ID NO: 296 - protein, 119 aa, Artificial Sequence
  Description of Artificial Sequence: Synthetic polypeptide
EVQLLESGGGLVQPGGSLRLSCAASGFTFDTETMHWVRQAPGKGLEWVSSIYVPGSYTYYADSVKGRFTISRDNSKNTLYLQMNSLRAEDTAVYYCAKGRHSDVEFDYWGQGTLVTVSS

SEQ ID NO: 297 - protein, 120 aa, Artificial Sequence; identical to SEQ ID NO: 276
  Description of Artificial Sequence: Synthetic polypeptide

SEQ ID NO: 298 - protein, 120 aa, Artificial Sequence
  Description of Artificial Sequence: Synthetic polypeptide
EVQLLESGGGLVQPGGSLRLSCAASGFTFDSANMTWVRQAPGKGLEWVSWIEDTGTQTFYADSVRGRFTISRDNFKNTLYLQMNSLRAEDTAVYYCAKSPFGPLYGFDYRGQGTLVTVSS

SEQ ID NO: 299 - protein, 120 aa, Artificial Sequence
  Description of Artificial Sequence: Synthetic polypeptide
EVQLLESGGGLVQPGGSLRLSCAASGFTFDSANMSWVRQAPGKGLEWVSWIEDTGTQTFYADSVKGRFTISRDNSKNTLYLQMNSLRAEDTAVYYCAKSPFGPLYGFDYRGQGTLVTVSS

SEQ ID NO: 300 - protein, 120 aa, Artificial Sequence
  Description of Artificial Sequence: Synthetic polypeptide
EVQLLESGGGLVQPGGSLRLSCAASGFTFHRWNMSWARQAPGKGLEWVSWIEDTGTQTFYADSVKGRFTISRDNSKNTLYLQMNSLRAEDTAVYYCAKSPFGPLYGFDYRGQGTLVTVSS

SEQ ID NO: 301 - protein, 120 aa, Artificial Sequence
  Description of Artificial Sequence: Synthetic polypeptide
EVQLLESGGGLVQPGGSLRLSCAASGFTFSRHNMSWVRQAPGKGLEWVSWIEDTGTQTFYADSVKGRFTISRDNSKNTLYLQMNSLRAEDTAVYYCAKSPFGPLYGFDYRGQGTLVTVSS

SEQ ID NO: 302 - protein, 120 aa, Artificial Sequence
  Description of Artificial Sequence: Synthetic polypeptide
EVQLLESGGGLVQPGGSLRLSCAASGFTFYKANMSWARQAPGKGLEWVSWIEDTGTQTFYADSVKGRFTISRDNSKNTLYLQMNSLRAEDTAVYYCAKSPFGPLYGFDYRGQGTLVTVSS

SEQ ID NO: 303 - protein, 120 aa, Artificial Sequence
  Description of Artificial Sequence: Synthetic polypeptide
EVQLLESGGGLVQPGGSLRLSCAASGFTFVRQNMSWVRQAPGKGLEWVSWIEDTGTQTFYADSVKGRFTISRDNSKNTLYLQMNSLRAEDTAVYYCAKSPFGPLYGFDYRGQGTLVTVSS

SEQ ID NO: 304 - protein, 120 aa, Artificial Sequence
  Description of Artificial Sequence: Synthetic polypeptide
EVQLLESGGGLVQPGGSLRLSCAASGFTFSRSNMSWVRQAPGKGLEWVSWIEDTGTQTFYADSVKGRFTISRDNSKNTLYLQMSSLRAEDTAVYYCAKSPFGPLYGFDYRGQGTLVTVSS

SEQ ID NO: 305 - protein, 120 aa, Artificial Sequence
  Description of Artificial Sequence: Synthetic polypeptide
EVQLLESGGGLVQPGGSLRLSCAASGFTFPLHNMSWVRQAPGKGLEWVSWIEDTGTQTFYADSVKGRFTISRDNSKNTLYLQMNSLRAEDTAVYYCAKSPFGPLYGFDYRGQGTLVTVSS

SEQ ID NO: 306 - protein, 120 aa, Artificial Sequence
  Description of Artificial Sequence: Synthetic polypeptide
EVQLLESGGGLVQPGGSLRLSCAASGFTFRASNMSWVRQAPGKGLEWVSWIEDTGTQTFYADSVKGRFTISRDNSKNTLYLQMNSLRAEDTAVYYCAKSPFGPLYGFDYRGQGTLVTVSS

SEQ ID NO: 307 - protein, 120 aa, Artificial Sequence
  Description of Artificial Sequence: Synthetic polypeptide
EVQLLESGGGLVQPGGSLRLSCAASGFTFESSNMSWVRQAPGKGLEWVSWIEDTGTQTFYADSVKGRFTISRDNSKNTLYLQMNSLRAEDTAVYYCAKSPFGPLYGFDYRGQGTLVTVSS

SEQ ID NO: 308 - protein, 120 aa, Artificial Sequence
  Description of Artificial Sequence: Synthetic polypeptide
EVQLLESGGGLVQPGGSLRLSCAASGFTFDKANMSWVRQAPGKGLEWVSWIEDTGTQTFYADSVKGRFTISRDNSKNTLYLQMNSLRAEDTAVYYCAKSPFGPLYGFDYRGQGTLVTVSS

SEQ ID NO: 309 - protein, 120 aa, Artificial Sequence
  Description of Artificial Sequence: Synthetic polypeptide
EVQLLESGGGLVQPGGSLRLSCAASGFTFYTSNMSWVRQAPGKGLEWVSWIEDTGTQTFYADSVKGRFTISRDNSKNTLYLQMNSLRAEDTAVYYCAKSPFGPLYGFDYRGQGTLVTVSS

SEQ ID NO: 310 - protein, 120 aa, Artificial Sequence
  Description of Artificial Sequence: Synthetic polypeptide
EVQLLESGGGLVQPGGSLRLSCAASGFTFASANMSWARQAPGKGLEWVSWIEDTGTQTFYADSVKGRFTISRDNSKNTLYLQMNSLRAEDTAVYYCAKSPFGPLYGFDYRGQGTLVTVSS

SEQ ID NO: 311 - protein, 120 aa, Artificial Sequence
  Description of Artificial Sequence: Synthetic polypeptide
EVQLLESGGGLVQPGGSLRLSCAASGFTFKDKNMSWARQAPGKGLEWVSWIEAPGVQTFYADSVRGRFTISRDNSKNTLYLQMNSLRAEDTAVYYCARSPFGPLYGFDYRGQGTLVTVSS

SEQ ID NO: 312 - protein, 120 aa, Artificial Sequence
  Description of Artificial Sequence: Synthetic polypeptide
EVQLLESGGGLVQPGGSLRLSCAASGFTFKDKNMSWARQAPGKGLEWVSWIEASGVQTFYADSVKGRFTISRDNSKNTLYLQMNSLRAEDTAVYYCAKSPFGPLYGFDYRGQGTLVTVSS

SEQ ID NO: 313 - protein, 120 aa, Artificial Sequence
  Description of Artificial Sequence: Synthetic polypeptide
EVQLLESGGGLVQPGGSLRLSCAASGFTFKDKNMSWARQAPGKGLEWVSWIEAIGVQTFYADSVKGRFTISRDNSKNTLYLQMNSLRAEDTAVYYCAKSPFGPLYGFDYRGQGTLVTVSS

SEQ ID NO: 314 - protein, 120 aa, Artificial Sequence
  Description of Artificial Sequence: Synthetic polypeptide
EVQLLESGGGLVQPGGSLRLSCAASGFTFKDKNMSWVRQAPGKGLEWVSWIEAPGVQTFYADSVRGRFTISRDNSKNTLYLQMNSLRAEDTAVYYCARSPFGPLYGFDYRGQGTLVTVSS

SEQ ID NO: 315 - protein, 120 aa, Artificial Sequence
  Description of Artificial Sequence: Synthetic polypeptide
EVQLLESGGGLVQPGGSLRLSCAASGFTFKDKNMSWVRQAPGKGLEWVSWIEASGVQTFYADSVKGRFTISRDNSKNTLYLQMNSLRAEDTAVYYCAKSPFGPLYGFDYRGQGTLVTVSS

SEQ ID NO: 316 - protein, 120 aa, Artificial Sequence
  Description of Artificial Sequence: Synthetic polypeptide
EVQLLESGGGLVQPGGSLRLSCAASGFTFVKANMSWVRQAPGKGLEWVSWIEDTGTQTFYADSVKGRFTISRDNSKNTLYLQMNSLRAEDTAVYYCAKSPFGPLYGFDYRGQGTLVTVSS

SEQ ID NO: 317 - protein, 120 aa, Artificial Sequence
  Description of Artificial Sequence: Synthetic polypeptide
EVQLLESGGGLVQPGGSLRLSCAASGFTFQHSNMSWVRQAPGKGLEWVSWIEDTGTQTFYADSVKGRFTISRDNSKNTLYLQMNSLRAEDTAVYYCAKSPFGPLYGFDYRGQGTLVTVSS

SEQ ID NO: 318 - protein, 120 aa, Artificial Sequence
  Description of Artificial Sequence: Synthetic polypeptide
EVQLLESGGGLVQPGGSLRLSCAASGFTFDEANMSWVRQAPGKGLEWVSWIEDTGTQTFYADSVKGRFTISRDNSKNTLYLQMNSLRAEDTAVYYCAKSPFGPLYGFDYRGQGTLVTVSS

SEQ ID NO: 319 - protein, 120 aa, Artificial Sequence
  Description of Artificial Sequence: Synthetic polypeptide
EVQLLESGGGLVQPGGSLRLSCAASGFTFTRANMSWVRQAPGKGLEWVSWIEDTGTQTFYADSVKGRFTISRDNSKNTLYLQMNSLRAEDTAVYYCAKSPFGPLYGFDYRGQGTLVTVSS

SEQ ID NO: 320 - protein, 120 aa, Artificial Sequence
  Description of Artificial Sequence: Synthetic polypeptide
EVQLLESGGGLVQPGGSLRLSCAASGFTFSRSNMSWGRQAPGKGLEWVSWIEDTGTQTFYADSVKGRFTISRDNSKNTLYLQMNSLRAEDTAVYYCAKSPFGPLYGFDYRGQGTLVTVSS

SEQ ID NO: 321 - protein, 120 aa, Artificial Sequence
  Description of Artificial Sequence: Synthetic polypeptide
EVQLLESGGGLVQPGGSLRLSCAASGFTFDKSNMSWARQAPGKGLEWVSWIEDTGTQTFYADSVKGRFTISRDNSKNTLYLQMNSLRAEDTAVYYCAKSPFGPLYGFDYRGQGTLVTVSS

SEQ ID NO: 322 - protein, 120 aa, Artificial Sequence
  Description of Artificial Sequence: Synthetic polypeptide
EVQLLESGGGLVQPGGSLRLSCAASGFTFKLSNMSWARQAPGKGLEWVSWIEDTGTQTFYADSVKGRFTISRDNSKNTLYLQMNSLRAEDTAVYYCAKSPFGPLYGFDYRGQGTLVTVSS

SEQ ID NO: 323 - protein, 120 aa, Artificial Sequence
  Description of Artificial Sequence: Synthetic polypeptide
EVQLLESGGGLVQPGGSLRLSCAASGFTFYRSNMSWVRQAPGKGLEWVSWIEDTGTQTFYADSVKGRFTISRDNSKNTLYLQMNSLRAEDTAVYYCAKSPFGPLYGFDYRGQGTLVTVSS

SEQ ID NO: 324 - protein, 120 aa, Artificial Sequence
  Description of Artificial Sequence: Synthetic polypeptide
EVQLLESGGGLVQPGGSLRLSCAASGFTFARSNMSWVRQAPGKGLEWVSWIEDTGTQTFYADSVKGRFTISRDNSKNTLYLQMNSLRAEDTAVYYCAKSPFGPLYGFDYRGQGTLVTVSS

SEQ ID NO: 325 - protein, 120 aa, Artificial Sequence
  Description of Artificial Sequence: Synthetic polypeptide
EVQLLESGGGLVQPGGSLRLSCAASGFTFQRSNMSWVRQAPGKGLEWVSWIEDTGTQTFYADSVKGRFTISRDNSKNTLYLQMNSLRAEDTAVYYCAKSPFGPLYGFDYRGQGTLVTVSS

SEQ ID NO: 326 - protein, 120 aa, Artificial Sequence
  Description of Artificial Sequence: Synthetic polypeptide
EVQLLESGGGLVQPGGSLRLSCAASGFTFSYANMSWVRQAPGKGLEWVSWIEDTGTQTFYADSVKGRFTISRDNSKNTLYLQMNSLRAEDTAVYYCAKSPFGPLYGFDYRGQGTLVTVSS

SEQ ID NO: 327 - protein, 120 aa, Artificial Sequence
  Description of Artificial Sequence: Synthetic polypeptide
EVQLLESGGGLVQPGGSLRLSCAASGFTFSHNNMSWVRQAPGKGLEWVSWIEDTGTQTFYADSVKGRFTISRDNSKNTLYLQMNSLRAEDTAVYYCAKSPFGPLYGFDYRGQGTLVTVSS

SEQ ID NO: 328 - protein, 120 aa, Artificial Sequence
  Description of Artificial Sequence: Synthetic polypeptide
EVQLLESGGGLVQPGGSLRLSCAASGFTFRLQNMSWVRQAPGKGLEWVSWIEDTGTQTFYADSVKGRFTISRDNSKNTLYLQMNSLRAEDTAVYYCAKSPFGPLYGFDYRGQGTLVTVSS

SEQ ID NO: 329 - protein, 120 aa, Artificial Sequence
  Description of Artificial Sequence: Synthetic polypeptide
EVQLLESGGGLVQPGGSLRLSCAASGFTFKSANMSWVRQAPGKGLEWVSWIEDTGTQTFYADSVKGRFTISRDNSKNTLYLQMNSLRAEDTAVYYCAKSPFGPLYGFDYRGQGTLVTVSS

SEQ ID NO: 330 - protein, 120 aa, Artificial Sequence
  Description of Artificial Sequence: Synthetic polypeptide
EVQLLESGGGLVQPGGSLRLSCAASGFTFNHANMSWVRQAPGKGLEWVSWIEDTGTQTFYADSVKGRFTISRDNYKNTLYLQMNSLRAEDTAVYYCAKSPFGPLYGFDYRGQGTLVTVSS

SEQ ID NO: 331 - protein, 120 aa, Artificial Sequence
  Description of Artificial Sequence: Synthetic polypeptide
EVQLLESGGGLVQPGGSLRLSCAASGFTFHRANMSWVRQAPGKGLEWVSWIEDTGTQTFYADSVKGRFTISRDNSKNTLYLQMNSLRAEDTAVYYCAKSPFGPLYGSDYRGQGTLVTVSS

SEQ ID NO: 332 - protein, 120 aa, Artificial Sequence
  Description of Artificial Sequence: Synthetic polypeptide
EVQLLESGGGLVQPGGSLRLSCAASGFTFARTNMSWARQAPGKGLEWVSWIEDTGTQTFYADSVKGRFTISRDNSKNTLYLQMNSLRAEDTAVYYCAKSPFGPLYGFDYRGQGTLVTVSS

SEQ ID NO: 333 - protein, 120 aa, Artificial Sequence
  Description of Artificial Sequence: Synthetic polypeptide
EVQLLESGGGLVQPGGSLRLSCAASGFTFDSANMSWVRQAPGKGLEWVSWIESIGVQTFYADSVKGRFTISRDNSKNTLYLQMNSLRAEDTAVYYCAKSPFGPLYGFDYRGQGTLVTVSS

SEQ ID NO: 334 - protein, 120 aa, Artificial Sequence
  Description of Artificial Sequence: Synthetic polypeptide
EVQLLESGGGLVQPGGSLRLSCAASGFTFDSANMSWVRQAPGKGLEWVSWIEASGTQTFYADSVKGRFTISRDNSKNTLYLQMNSLRAEDTAVYYCAKSPFGPLYGFDYRGQGTLVTVSS

SEQ ID NO: 335 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEALGVQTFYADSVKGRFTISRDNSKNTLYLQMNSLRAEDTAVYYCAKSPFGPLYGFDSRGQGTLVTVSS

SEQ ID NO: 336 - protein, 120 aa, Artificial Sequence
  Description of Artificial Sequence: Synthetic polypeptide
EVQLLESGGGLVQPGGSLRLSCAASGFTFDSANMSWVRQAPGKGLEWVSWIEASGRQTFYADSVKGRFTISRDNSKNTLYLQMNGLRAEDTAVYYCAKSPFGPLYGFDYRGQGTLVTVSS

SEQ ID NO: 337 - protein, 120 aa, Artificial Sequence
  Description of Artificial Sequence: Synthetic polypeptide
EVQLLESGGGLVQPGGSLRLSCAASGFTFDSANMSWVRQAPGKGLEWVSWIEAAGPQTFYADSVKGRFTISRDNSKDTLYLQMNSLRAEDTAVYYCAKSPFGPLYGFDYRGQGTLVTVSS

SEQ ID NO: 338 - protein, 120 aa, Artificial Sequence
  Description of Artificial Sequence: Synthetic polypeptide
EVQLLESGGGLVQPGGSLRLSCAASGFTFDSANMSWVRQAPGKGLEWVSWIENGGGQTFYADSVKGRFTISRDNSKNTLYLQMNSLRAEDTAVYYCAKSPFGPLYGFDYRGQGTLVTVSS

SEQ ID NO: 339 - protein, 120 aa, Artificial Sequence
  Description of Artificial Sequence: Synthetic polypeptide
EVQLLESGGGLVQPGGSLRLSCAASGFTFDSANMSWVRQAPGKGLEWVSWIEAPGKQTFYADSVKGRFTISRDNSKNTLYLQMNSLRAEDTAVYYCAKSPFGPLYGFDYRGRGTLVTVSS

SEQ ID NO: 340 - protein, 120 aa, Artificial Sequence; identical to SEQ ID NO: 272
  Description of Artificial Sequence: Synthetic polypeptide

SEQ ID NO: 341 - protein, 120 aa, Artificial Sequence; identical to SEQ ID NO: 273
  Description of Artificial Sequence: Synthetic polypeptide

SEQ ID NO: 342 - protein, 120 aa, Artificial Sequence
  Description of Artificial Sequence: Synthetic polypeptide
EVQLLESGGGLVQPGGSLRLSCAASGFTFDSANMSWVRQAPGKGLEWVSWIENNGPQTFYADSVKGRFTISRDDSKNTLYLQMNSLRAEDTAVYYCAKSPFGPLYGFDYRGQGTLVTVSS

SEQ ID NO: 343 - protein, 120 aa, Artificial Sequence
  Description of Artificial Sequence: Synthetic polypeptide
EVQLLESGGGLVQPGGSLRLSCAASGFTFDSANMSWGRQAPGKGLEWVSWIEASGVQTFYADSVKGRFTISRDNSKNTLYLQMNSLRAEDTAVYYCAKSPFGPLYGFDYRGQGTLVTVSS

SEQ ID NO: 344 - protein, 120 aa, Artificial Sequence
  Description of Artificial Sequence: Synthetic polypeptide
EVQLLESGGGLVQPGGSLRLSCAASGFTFDSANMSWVRQAPGKGLEWVSWIESSGPQTFYADSVKGRFTISRDNSKNTLYLQMNSLRAEDTAVYYCAKSPFGPLYGFDYRGQGTLVTVSS

SEQ ID NO: 345 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEASGFQTFYADSVKGRFTISRDNSKNTLYLQMNSLRAEDTAVYYCAKSPFGPLYGFDYRGQGTLVTVSS

SEQ ID NO: 346 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEASGGQTFYADSVKGRFTISRDNSKNTLYLQMNSLRAEDTAVYYCAKSPFGPLYGFDYRGQGTLVTVSS

SEQ ID NO: 347 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEDQGVQTFYADSVKGRFTISRDNSKSTLYLQMNSLRAEDTAVYYCAKSPFGPLYGFDYRGQGTLVTVSS

SEQ ID NO: 348 - protein, 120 aa, Artificial Sequence
  Description of Artificial Sequence: Synthetic polypeptide
EVQLLESGGGLVQPGGSLRLSCAASGFTFDSANMSWVRQAPGKGLEWVSWIEDIGIQTFYADSVKGRFTISRDNSKNTLYLQMNSLRAEDTAVYYCAKSPFGPLYGFDYRGQGTLVTVSS

SEQ ID NO: 349 - protein, 120 aa, Artificial Sequence
  Description of Artificial Sequence: Synthetic polypeptide
EVQLLESGGGLVQPGGSLRLSCAASGFTFDSANMSWVRQAPGKGLEWVSWIEDIGVQTFYADSVKGRFTISRDNSKNTLYLQMNSLRAEDTAVYYCAKSPFGPLYGFDYRGQGTLVTVSS

SEQ ID NO: 350 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEATGGQTFYADSVKGRFTISRDNSKNTLYLQMNSLRAEDTAVYYCAKSPFGPLYGFDYRGQGTLVTVSS

SEQ ID NO: 351 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEAEGGQTFYADSVKGRFTISRDNSKNTLYLQMNSLRAEDTAVYYCAKSPFGPLYGFDYRGQGTLVTVSS

SEQ ID NO: 352 - protein, 120 aa, Artificial Sequence
  Description of Artificial Sequence: Synthetic polypeptide
EVQLLESGGGLVQPGGSLRLSCAASGFTFDSANMSWVRQAPGKGLEWVSWIESSGYQTFYADSVKGRFTISRDNSKNTLYLQMNSLRAEDTAVYYCAKSPFGPLYGFDYRGQGTLVTVSS

SEQ ID NO: 353 - protein, 120 aa, Artificial Sequence
  Description of Artificial Sequence: Synthetic polypeptide
EVQLLESGGGLVQPGGSLRLSCAASGFTFDSANMSWVRQAPGKDLEWVSWIEDSGIQTFYADSVKGRFTISRDNSRNTLYLQMNSLRAEDTAVYYCAKSPFGPLYGFDYRGQGTLVTVSS

SEQ ID NO: 354 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIESSGGQTFYADSVKGRFTISRDNSKNTLYLQMNSLRAEDTAVYYCAKSPFGPLYGFDYRGQGTLVTVSS

SEQ ID NO: 355 - protein, 120 aa, Artificial Sequence
  Description of Artificial Sequence: Synthetic polypeptide
EVQLLESGGGLVQPGGSLRLSCAASGFTFDSANMSWVRQAPGKGLEWVSWIESRGPQTFYADSVKGRFTISRDNSKNTLYLQMNSLRAEDTAVYYCAKSPFGPLYGFDYRGQGTLVTVSS

SEQ ID NO: 356 - protein, 120 aa, Artificial Sequence
  Description of Artificial Sequence: Synthetic polypeptide
EVQLLESGGGLVQPGGSLRLSCAASGFTFDSANMSWVRQAPGKGLEWVSWIEAIGVQTFYADSVKGRFTISRDNSKNTLYLQMNSLRAEDTAVYYCAKSPFGPLYGFDYRGQGTLVTVSS

SEQ ID NO: 357 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEDGGLQTFYADSVKGRFTISRDNSKNTLYLQMNSLRAEDTAVYYCAKSPFGPLYGFDYRGQGTLVTVSS

SEQ ID NO: 358 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIESHGGQTFYADSVKGRFTISRDNSKNTLYLQMNSLRAEDTAVYYCAKSPFGPLYGFDYRGQGTLVTVSS

SEQ ID NO: 359 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEGSGQQTFYADSVKGRFTISRDNSKNTLYLQMNSLRAEDTAVYYCAKSPFGPLYGFDYRGQGTLVTVSS

SEQ ID NO: 360 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEANGPQTFYADSVKGRFTISRDNSKNTLYLQMNSLRAEDTAVYYCAKSPFGPLYGFDYRGQGTLVTVSS

SEQ ID NO: 361 - protein, 120 aa, Artificial Sequence
  Description of Artificial Sequence: Synthetic polypeptide
EVQLLESGGGLVQPGGSLRLSCAASGFTFDSANMSWVRQAPGKGLEWVSWIEASGVQTFYADSVKGRFTISRDNSKNTLYLQMNSLRAEDTAVYYCAKSPFGPLYGFDYRGQGTLVTVSS

SEQ ID NO: 362 - protein, 120 aa, Artificial Sequence
  Description of Artificial Sequence: Synthetic polypeptide
EVQLLESGGGLVQPGGSLRLSCAASGFTFYKANMSWVRQAPGKGLEWVSWIEASGVQTFYADSVKGRFTISRDNSKNTLYLQMNSLRAEDTAVYYCAKSPFGPLYGFDYRGQGTLVTVSS

SEQ ID NO: 363 - protein, 120 aa, Artificial Sequence
  Description of Artificial Sequence: Synthetic polypeptide
EVQLLESGGGLVQPGGSLRLSCAASGFTFDKSNMSWVRQAPGKGLEWVSWIEAPGVQTFYADSVRGRFTISRDNSKNTLYLQMNSLRAEDTAVYYCARSPFGPLYGFDYRGQGTLVTVSS

SEQ ID NO: 364 - protein, 120 aa, Artificial Sequence
  Description of Artificial Sequence: Synthetic polypeptide
EVQLLESGGGLVQPGGSLRLSCAASGFTFDKSNMSWARQAPGKGLEWVSWIEASGVQTFYADSVKGRFTISRDNSKNTLYLQMNSLRAEDTAVYYCAKSPFGPLYGFDYRGQGTLVTVSS

SEQ ID NO: 365 - protein, 120 aa, Artificial Sequence
  Description of Artificial Sequence: Synthetic polypeptide
EVQLLESGGGLVQPGGSLRLSCAASGFTFYRSNMSWVRQAPGKGLEWVSWIEAPGVQTFYADSVRGRFTISRDNSKNTLYLQMNSLRAEDTAVYYCARSPFGPLYGFDYRGQGTLVTVSS

SEQ ID NO: 366 - protein, 120 aa, Artificial Sequence
  Description of Artificial Sequence: Synthetic polypeptide
EVQLLESGGGLVQPGGSLRLSCAASGFTFYRSNMSWVRQAPGKGLEWVSWIEASGVQTFYADSVKGRFTISRDNSKNTLYLQMNSLRAEDTAVYYCAKSPFGPLYGFDYRGQGTLVTVSS

SEQ ID NO: 367 - protein, 120 aa, Artificial Sequence
  Description of Artificial Sequence: Synthetic polypeptide
EVQLLESGGGLVQPGGSLRLSCAASGFTFKSANMSWVRQAPGKGLEWVSWIEAPGVQTFYADSVRGRFTISRDNSKNTLYLQMNSLRAEDTAVYYCARSPFGPLYGFDYRGQGTLVTVSS

SEQ ID NO: 368 - protein, 120 aa, Artificial Sequence
  Description of Artificial Sequence: Synthetic polypeptide
EVQLLESGGGLVQPGGSLRLSCAASGFTFKSANMSWVRQAPGKGLEWVSWIEASGVQTFYADSVKGRFTISRDNSKNTLYLQMNSLRAEDTAVYYCAKSPFGPLYGFDYRGQGTLVTVSS

SEQ ID NO: 369 - protein, 120 aa, Artificial Sequence
  Description of Artificial Sequence: Synthetic polypeptide
EVQLLESGGGLVQPGGSLRLSCAASGFTFYKANMSWARQAPGKGLEWVSWIEASGVQTFYADSVKGRFTISRDNSKNTLYLQMNSLRAEDTAVYYCAKSPFGPLYGFDYRGQGTLVTVSS

SEQ ID NO: 370 - protein, 120 aa, Artificial Sequence
  Description of Artificial Sequence: Synthetic polypeptide
EVQLLESGGGLVQPGGSLRLSCAASGFTFKDKNMSWARQAPGKGLEWVSWIEDTGTQTFYADSVKGRFTISRDNSKNTLYLQMNSLRAEDTAVYYCARSPFGPLYGFDYRGQGTLVTVSS

SEQ ID NO: 371 - protein, 120 aa, Artificial Sequence
  Description of Artificial Sequence: Synthetic polypeptide
EVQLLESGGGLVQPGGSLRLSCAASGFTFNRANMSWARQAPGKGLEWVSWIEDTGTQTFYADSVKGRFTISRDNSKNTLYLQMNSLRAEDTAVYYCAKSPFGPLYGFDYRGQGTLVTVSS

SEQ ID NO: 372 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEAVGVQTFYADSVKGRFTISRDNSKNTLYLQMNSLRAEDTAVYYCAKSPFGPLYGFDYRGQGTLVTVSS

SEQ ID NO: 373 - protein, 120 aa, Artificial Sequence
  Description of Artificial Sequence: Synthetic polypeptide
EVQLLESGGGLVQPGGSLRLSCAASGFTFPHSNMSWARQAPGKGLEWVSWIEDTGTQTFYADSVKGRFTISRDNSKNTLYLQMNSLRAEDTAVYYCAKSPFGPLYGFDYRGQGTLVTVSS

SEQ ID NO: 374 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEAIGVQTFYADSVKGRFTISRDNSKNTLYLQMNSLRAEDTAVYYCAKSPFGPLYGFDYRGQGTLVTVSS

SEQ ID NO: 375 - protein, 120 aa, Artificial Sequence
  Description of Artificial Sequence: Synthetic polypeptide
EVQLLESGGGLVQPGGSLRLSCAASGFTFDSANMTWVRQAPGKGLEWVSWIDDTGTQTFYEDSVKGRFTISRDNSKNTLYLQMNSLRAEDTAVYYCAKSPFGPLYGFDYRGQGTLVTVSS

SEQ ID NO: 376 - protein, 120 aa, Artificial Sequence
  Description of Artificial Sequence: Synthetic polypeptide
EVQLLESGGGLVQPGGSLRLSCAASGFTFDSANMTWVRQAPGKGLEWVSWIDDIGSQTFYADSVKGRFTISRDNSKNTLYLQMNSLRAEDTAVYYCAKSPFGPLYGFDYRGQGTLVTVSS

SEQ ID NO: 377 - protein, 120 aa, Artificial Sequence
  Description of Artificial Sequence: Synthetic polypeptide
EVQLWESGGGLVQPGGSLRLSCAASGFTFDSANMTWVRQAPGKDLEWVSWIEDTGTQTFYADSVKGRFTISRDNSKNTLYLQMNSLRAEDTAVYYCAKSPFGPLYGFDYRGQGTLVTVSS

SEQ ID NO: 378 - protein, 120 aa, Artificial Sequence
  Description of Artificial Sequence: Synthetic polypeptide
EVQLLESGGGLVQPGGSLRLSCAASGFTFDSANMSWVRQAPGKGLEWVSWIEDTGTQTFYADSVKGRFTISRDNSKNTLYLQMNSLRAEDTAVYYCAKSPFGPLYGFDYWGQGTLVTVSS

SEQ ID NO: 379 - protein, 120 aa, Artificial Sequence
  Description of Artificial Sequence: Synthetic polypeptide
EVQLLESGGGLVQPGGSLRLSCAASGFTFDSANMTWVRQAPGKGLEWVSWIDDIGSQTFYADSVKGRFTISRDNSKNTLYLQMNSLRAEDTAVYYCAKSPFGPLYGFDYWGQGTLVTVSS

SEQ ID NO: 380 - protein, 122 aa, Artificial Sequence
  Description of Artificial Sequence: Synthetic polypeptide
EVQLLESGGGLVQPGGSLRLSCAASGFTFESYWMSWVRQAPGKGLEWVSTIADTGGLTYYADSVKGRFTISRDNSKNTLYLQMNSLRAEDTAVYYCAKVAYVLDDQPAFDYWGQGTLVTVSS

SEQ ID NO: 381 - protein, 121 aa, Artificial Sequence
  Description of Artificial Sequence: Synthetic polypeptide
EVQLLESGGGLVQPGGSLRLSCAASGFTFGDVSMGWVRQAPGKGLEWVSGIDGPGSNTYYADSVKGRFTISRDNSKNTLYLQMNSLRAEDTAVYYCAKNHAGSTRNVFDYWSQGTLVTVSS

SEQ ID NO: 382 - protein, 123 aa, Artificial Sequence
  Description of Artificial Sequence: Synthetic polypeptide
EVQLLESGGGLVQPGGSLRLSCAASGFTFSDYSMSWVRQAPGKGLEWVSSIRPSGLSTYYADSVKGRFTISRDNSKNTLYLQMNSLRAEDTAVYYCAKQRARRYQDRPRFDYWGQGTLVTVSS

SEQ ID NO: 383 - protein, 120 aa, Artificial Sequence
  Description of Artificial Sequence: Synthetic polypeptide
EVQLLESGGGLVQPGGSLRLSCAAAGFTFDHTEMGWVRQAPGKGLEWVSAITSDGLNTYYADSVKGRFTISRDNSKNTLYLQMNSLRAEDTAVYYCAKGQDRPPWSFDYWGQGTLVTVSS

SEQ ID NO: 384 - protein, 121 aa, Artificial Sequence
  Description of Artificial Sequence: Synthetic polypeptide
EVQLLESGGGLVQPGGSLRLSCADSGLTFSSYAMSWVRQAPGKGLEWVSSISTDGMGTYYADSVKGRFTISRDNSKNTLYLQMNSLRAEDTAVYYCAKYLSAPVLMAYDYWGQGTLVTVSS

SEQ ID NO: 385 - protein, 122 aa, Artificial Sequence
  Description of Artificial Sequence: Synthetic polypeptide
EVQLLESGGGLVQPGGSLRLSCAASGFTFPPYTMGWVRQAPGKGLEWVSWISSSGRKTYYADSVKGRFTISRDNSKNTLYLQMNSLRAEDTAVYYCAKFRKSSVLRSMFDYWGQGTLVTVSS

SEQ ID NO: 386 - protein, 122 aa, Artificial Sequence
  Description of Artificial Sequence: Synthetic polypeptide
EVQLLESGGGLVQPGGSLRLSCAASGFTFSRYPMSWVRQAPGKGLEWVSTIGGLGKTTYYADSVKGRFTISRDNSKNTLYLQMNSLRAEDTAVYYCAESNMYRSIKYPFAYWGQGTLVTVSS

SEQ ID NO: 387 - protein, 124 aa, Artificial Sequence
  Description of Artificial Sequence: Synthetic polypeptide
EVQLLESGGGLVQPGGSLRLSCAASGFTFAKYGMGWVRQAPGKGLEWVSGINGSGIWTYYADSVKGRFTISRDNSKNTLYLQMNSLRAEDTAVYYCAKGHVHSPPRGPFLFDYWGQGTLVTVSS

SEQ ID NO: 388 - protein, 121 aa, Artificial Sequence
  Description of Artificial Sequence: Synthetic polypeptide
EVQLLESGGGLVQPGGSLRLSCAASGFTFASYSMAWVRQAPGKGLEWVSTIMPSGQRTYYADSVKGRFTISRDNSKNTLYLQMNSLRAEDTAVYYCAKNQSHQRRGIFDYWGQGTLVTVSS

SEQ ID NO: 389 - protein, 124 aa, Artificial Sequence
  Description of Artificial Sequence: Synthetic polypeptide
EVQLLESGGGLVQPGGSLRLSCAASGFTFSEYSMAWVRQAPGKGLEWVSHISRDGEFTYYADSVKGRFTISRDNSKNTLYLQMNSLRAEDTAVYYCAKGNADLGWVQPHLFVYWGQGTLVTVSS

SEQ ID NO: 390 - protein, 123 aa, Artificial Sequence
  Description of Artificial Sequence: Synthetic polypeptide
EVQLLESGGGLVQPGGSLRLSCAASGFTFWRYNMGWARQAPGKGLEWVSSISPTGSITYYADSVKGRFTISRDNSKNTLYLQMNSLRAEDTAVYYCAKWIGLMSLHPADFDYWGQGTLVTVSS

SEQ ID NO: 391 - protein, 119 aa, Artificial Sequence; identical to SEQ ID NO: 296
  Description of Artificial Sequence: Synthetic polypeptide

SEQ ID NO: 392 - protein, 121 aa, Artificial Sequence
  Description of Artificial Sequence: Synthetic polypeptide
EVQLLESGGGLVQPGGSLRLSCAASGFTFTDRCMMWVRQAPGKGLEWVSSIQVEGNHTYYADSVKGRFTISRDNSKNTLYLQMNSLRAEDTAVYYCAKCMTVGPGNSFDYWGQGTLVTVSS

SEQ ID NO: 393 - protein, 121 aa, Artificial Sequence
  Description of Artificial Sequence: Synthetic polypeptide
EVQLLESGGGLVQPGGSLRLSCAASGFTFGTYKMVWVRQAPGKGLEWVSSIGPGGLDTYYADSVKGRFTISRDNSKNTLYLQMNSLRAEDTAVYYCAKSWMTLPITGFDYWGQGTLVTVSS

SEQ ID NO: 394 - protein, 121 aa, Artificial Sequence
  Description of Artificial Sequence: Synthetic polypeptide
EVQLLESGGGLVQPGGSLRLSCAASGITFGTYKMVWVRQAPGKGLEWVSSIGPGGLDTYYADSVKGRFTISRDNSKNTLYLQMNSLRAEDTAVYYCAISWMTLPITGFDYWGQGTLVTVSS

SEQ ID NO: 395 - protein, 120 aa, Artificial Sequence
  Description of Artificial Sequence: Synthetic polypeptide
EVQLLESGGGLVQPGGSLRLSCAASGFTFDSAAMTWVRQAPGKGLEWVSWIDDTGTQTYYADSVKGRFTISRDNSKNTLYLQMNSLRAEDTAVYYCAKSPFGPLYGFDYWGQGTLVTVSS

SEQ ID NO: 396 - protein, 121 aa, Artificial Sequence
  Description of Artificial Sequence: Synthetic polypeptide
EVQLLESGGGLVQPGGSLRLSCAASGFTFGTYKMVWVRQAPGKGLEWVSSIGPGGLDTYYADSVKGRFTISRDNSKNTLYLQMNSLRAEDTAVYYCAKSWMTLPITGFDYWGQGTLVTVSC

SEQ ID NO: 397 - protein, 108 aa, Artificial Sequence
  Description of Artificial Sequence: Synthetic polypeptide
DIQMTQSPSSLSASVGDRVTITCRASQHINASLGWYQQKPGKAPRLLIYWASQLQSGVPSRFSGSGSGTDFTLTISSLQPEDFATYYCQQMVRTPFTFGQGTKVEIKR

SEQ ID NO: 398 - protein, 120 aa, Artificial Sequence
  Description of Artificial Sequence: Synthetic polypeptide
EVQLLESGGGLVQPGGSLRLSCAASGFTFYKANMSWVRQAPGKGLEWVSWIEAPGVQTFYADSVRGRFTISRDNSKNTLYLQMNSLRAEDTAVYYCARSPFGPLYGFDYRGQGTLVTVSS

SEQ ID NO: 399 - protein, 120 aa, Artificial Sequence
  Description of Artificial Sequence: Synthetic polypeptide
EVQLLESGGGLVQPGGSLRLSCAASGFRISDEDMGWVRQAPGKGLEWVSSIYGPSGSTYYADSVKGRFTISRDNSKNTLYLQMNSLRAEDTAVYYCASALEPLSEPLGFWGQGTLVTVSS

SEQ ID NO: 400 - protein, 108 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSYSTPNTFGQGTKVEIKR

SEQ ID NO: 401 - protein, 116 aa, Artificial Sequence
  Description of Artificial Sequence: Synthetic polypeptide
EVQLLESGGGLVQPGGSLRLSCAASGFTFSRYHMAWVRQAPGKGLEWVSVIDSLGLQTYYADSVKGRFTISRDNSKNTLYLQMNSLRAEDTAVYYCAEYGGAFDYWGQGTLVTVSS

SEQ ID NO: 402 - protein, 123 aa, Artificial Sequence
  Description of Artificial Sequence: Synthetic polypeptide
EVQLLESGGGLVQPGGSLRLSCAASGFTFPAYSMIWVRQAPGKGLEWVSTISPLGYSTYYADSVKGRFTISRDNSKNTLYLQMNSLRAEDTAVYYCAEQTAYLNRATEHFDYWGQGTLVTVSS

SEQ ID NO: 403 - protein, 116 aa, Artificial Sequence
  Description of Artificial Sequence: Synthetic polypeptide
EVQLLESGGGLVQPGGSLRLSCAASGFTFDAYSMIWVRQAPGKGLEWVSTITPQGDRTYYADSVKGRFTISRDNSKNTLYLQMNSLRAEDTAVYYCAQAGWSFDYWGQGTLVTVSS

SEQ ID NO: 404 - protein, 116 aa, Artificial Sequence
  Description of Artificial Sequence: Synthetic polypeptide
EVQLLESGGGLVQPGGSLRLSCAASGFTFVDYEMAWVRQAPGKGLEWVSTISNDGAATYYADSVKGRFTISRDNSKNTLYLQMNSLRAEDTAVYYCAKDDAAFDYWGQGALVTVSS

SEQ ID NO: 405 - protein, 116 aa, Artificial Sequence
  Description of Artificial Sequence: Synthetic polypeptide
EVQLLESGGGLVQPGGSLRLSCAASGFTFGAYSMGWARQAPGKGLEWVSWITGNGGSTYYADSVKGRFTISRDNSKNTLYLQMNSLRAEDTAVYYCAKAEEPFDYWGQGTLVTVSS

SEQ ID NO: 406 - protein, 116 aa, Artificial Sequence; identical to SEQ ID NO: 401
  Description of Artificial Sequence: Synthetic polypeptide

SEQ ID NO: 407 - protein, 117 aa, Artificial Sequence
  Description of Artificial Sequence: Synthetic polypeptide
EVQLLESGGGLVQPGGSLRLSCAASGFTFTHYSMGWVRQAPGKGLEWVSHITPDGLITYYADSVKGRFTISRDNSKNTLYLQMNSLRAEDTAVYYCAKGRLVDFDYWGQGTLVTVSS

SEQ ID NO: 408 - protein, 118 aa, Artificial Sequence
  Description of Artificial Sequence: Synthetic polypeptide
EVQLLESGGGLVQPGGSLRLSCAASGFTFENYGMAWVRQAPGKGLEWVSNIGRAGSVTYYADSVKGRFTISRDNSKNTLYLQMNSLRAEDTAVYYCAKVQSWRTFDYWGQGTLVTVSS

SEQ ID NO: 409 - protein, 119 aa, Artificial Sequence
  Description of Artificial Sequence: Synthetic polypeptide
EVQLLESGGGLVQPGGSLRLSCAASGFTFPAYSMGWVRQAPEKGLEWVSYIDGRGAETYYADSVKGRFTISRDNSKNTLYLQMNSLRAEDTAVYYCAKIDTLISEFDYWGQGTLVTVSS

SEQ ID NO: 410 - protein, 119 aa, Artificial Sequence
  Description of Artificial Sequence: Synthetic polypeptide
EVQLLESGGGLVQPGGSLRLSCAASGFTFPNYTMWWVRQAPGKGLEWVSSISGTGHTTYYADSVKGRFTISRDNSKNTLYLQMNSLRAEDTAVYYCAKFGPNNPMFDYWGQGTLVTVSS

SEQ ID NO: 411 - protein, 119 aa, Artificial Sequence
  Description of Artificial Sequence: Synthetic polypeptide
EVQLLESGGGLVQPGGSLRLSCAASGFTFASYDMGWVRQAPGKGLEWVSAISADGTFTYYADSVKGRFTISRDNSKNTLYLQMNSLRAEDTAVYYCAKSSFDKYNFDYWGQGTLVTVSS

SEQ ID NO: 412 - protein, 119 aa, Artificial Sequence
  Description of Artificial Sequence: Synthetic polypeptide
EVQLLESGGGLVQPGGSLRLSCAASGFTFAKYTMWWVRQAPGKGLEWVSSIDPVGNLTYYADSVKGRFTISRDNSKNTLYLQMNSLRAEDTAVYYCAKRGPTSSNFDYWGQGTLVTVSS

SEQ ID NO: 413 - protein, 120 aa, Artificial Sequence
  Description of Artificial Sequence: Synthetic polypeptide
EVQLLESGGGLVQPGGSLRLSCAASGFTFSEYGMKWVRQAPGKGLEWVSTIDNVGSVTYYADSVKGRFTISRDNSKNTLYLQMNSLRAEDTAVYYCAKTTPVLLPLFDYWGQGTLVTVSS

SEQ ID NO: 414 - protein, 120 aa, Artificial Sequence
  Description of Artificial Sequence: Synthetic polypeptide
EVQLLESGGGLVQPGGSLRLSCAASGFTFDSYNMGWVRQAPGKGLEWVSAIAANGRVTYYADSVKGRFTISRDNSKNTLYLQMNSLRAEDTAVYYCAKMTNMAYGSFDYWGQGTLVTVSS

SEQ ID NO: 415 - protein, 120 aa, Artificial Sequence
  Description of Artificial Sequence: Synthetic polypeptide
EVQLLESGGGLVQPGGSLRLSCAASGFTFDLYSMAWVRQAPGKGLEWVSHIDRAGMITYYADSVKGRFTISRDNSKNTLYLQMNSLRAEDTAVYYCAKVSNAVNMQFDYWGQGTLVTVSS

SEQ ID NO: 416 - protein, 120 aa, Artificial Sequence
  Description of Artificial Sequence: Synthetic polypeptide
EVQLLESGGGLVQPGGSLRLSCAASGFTFAKYTMWWVRQAPGKGLEWVSSIDPVGNLTYYADSVKGRFTISRDNSKNTLYLQMNSLRAEDTAVYYCAKRHRPSTQDFDYWGQGTLVTVSS

SEQ ID NO: 417 - protein, 120 aa, Artificial Sequence
  Description of Artificial Sequence: Synthetic polypeptide
EVQLLESGGGLVQPGGSLRLSCAASGFTFPDYKMGWVRQAPGKGLEWVSWIDKGGIITYYADSVKGRFTISRDNSKNTLYLQMNSLRAEDTAVYYCAKMFPKFRPAFDYWGQGTLVTVSS

SEQ ID NO: 418 - protein, 120 aa, Artificial Sequence
  Description of Artificial Sequence: Synthetic polypeptide
EVQLLESGGGLVQPGGSLRLSCAASGFTFEDYGMGWVRQAPGKGLEWVSHINRSGLVTYYADSVKGRFTISRDNSKNTLYLQMNSLRAEDTAVYYCAKVLNAPNFKFDYWGQGTLVTVSS

SEQ ID NO: 419 - protein, 123 aa, Artificial Sequence
  Description of Artificial Sequence: Synthetic polypeptide
EVQLLESGGGLVQPGGSLRLSCAASGFTFNRYAMGWVRQAPGKGLEWVSWIDGNGLVTYYADSVKGRFTISRDNSKNTLYLQMNSLRAEDTAVYYCAKRTRSHSDSGWAFDYWGQGTLVTVSS

SEQ ID NO: 420 - protein, 123 aa, Artificial Sequence
  Description of Artificial Sequence: Synthetic polypeptide
EVQLLESGGGLVQPGGSLRLSCAASGFTFGNYNMGWVRQAPGKGLEWVSGITKGGRVTYYADSVKGRFTISRDNSKNTLYLQMNSLRAEDTAVYYCAKLGPSRMLNEPLFDYWGQGTLVTVSS

SEQ ID NO: 421 - protein, 123 aa, Artificial Sequence; identical to SEQ ID NO: 402
  Description of Artificial Sequence: Synthetic polypeptide

SEQ ID NO: 422 - protein, 123 aa, Artificial Sequence
  Description of Artificial Sequence: Synthetic polypeptide
EVQLLESGGGLVQPGGSLRLSCAASGFTFSKYDMAWVRQAPGKGLEWVSSIYAIGGNTYYADSVKGRFTISRDNSKNTLYLQMNSLRAEDTAVYYCAKLKSGMQTRLNSFDYWGQGTLVTVSS

SEQ ID NO: 423 - protein, 123 aa, Artificial Sequence; identical to SEQ ID NO: 286
  Description of Artificial Sequence: Synthetic polypeptide

SEQ ID NO: 424 - protein, 123 aa, Artificial Sequence
  Description of Artificial Sequence: Synthetic polypeptide
EVQLLESGGGLVQPGGSLRLSCAASGFTFGQYGMGWVRQAPGKGLEWVSGISPSGNYTYYADSVKGRFTISRDNSKNTLYLQMNSLRAEDTAVYYCAKGNGSLPPRGSIFDYWGQGTLVTVSS

SEQ ID NO: 425 - protein, 123 aa, Artificial Sequence; identical to SEQ ID NO: 420
  Description of Artificial Sequence: Synthetic polypeptide

SEQ ID NO: 426 - protein, 123 aa, Artificial Sequence
  Description of Artificial Sequence: Synthetic polypeptide
EVQLLESGGGLVQPGGSLRLSCAASGFTFGTYYMGWARQAPGKGLEWVSSIGANGAPTYYADSVKGRFTISRDNSKNTLYLQMNSLRAEDTAVYYCAKIRSLNRWAEPVFDYWGQGTLVTVSS

SEQ ID NO: 427 - protein, 116 aa, Artificial Sequence
  Description of Artificial Sequence: Synthetic polypeptide
EVQLLESGGGLVQPGGSLRLSCAASGFTFADYSMYWVRQAPGKGLEWVSQISPAGSFTYYADSVKGRFTISRDNSKNTLYLQMNSLRAEDTAVYYCAKDSKSFDYWGQGTLVTVSS

SEQ ID NO: 428 - protein, 117 aa, Artificial Sequence; identical to SEQ ID NO: 284
  Description of Artificial Sequence: Synthetic polypeptide

SEQ ID NO: 429 - protein, 118 aa, Artificial Sequence
  Description of Artificial Sequence: Synthetic polypeptide
EVQLLESGGGLVQPGGSLRLSCAASGFTFAMYSMKWVRQAPGKGLEWVSSISNAGDITYYADSVKGRFTISRDNSKNTLYLQMNSLRAEDTAVYYCAESFRSRYFDYWGQGTLVTVSS

SEQ ID NO: 430 - protein, 119 aa, Artificial Sequence
  Description of Artificial Sequence: Synthetic polypeptide
EVQLLESGGGLVQPGGSLRLSCAASGFTFDDYLMGWVRQAPGKGLEWVSLIRMRGSVTYYADSVKGRFTISRDNSKNTLYLQMNSLRAEDTAVYYCAKHSLTTNLFDYWGQGTLVTVSS

SEQ ID NO: 431 - protein, 119 aa, Artificial Sequence
  Description of Artificial Sequence: Synthetic polypeptide
EVQLLESGGGLVQPGGSLRLSCAASGFTFTDYMMAWARQAPGKGLEWVSIIGTTGTWTYYADSVKGRFTISRDNSKNTLYLQMNSLRAEDTAVYYCAKTNAYESEFDYWGQGTLVTVSS

SEQ ID NO: 432 - protein, 120 aa, Artificial Sequence
  Description of Artificial Sequence: Synthetic polypeptide
EVQLLESGGGLVQPGGSLRLSCAASGFTFARYTMVWVRQAPGKGLEWVSAIHFDGRTTYYADSVKGRFTISRDNSKNTLYLQMNSLRAEDTAVYYCAKNEWASLKHFDYWGQGTLVTVSS

SEQ ID NO: 433 - protein, 120 aa, Artificial Sequence
  Description of Artificial Sequence: Synthetic polypeptide
EVQLLESGGGLVQPGGSLRLSCAASGFTFEDYMMGWVRQAPGKGLEWVSFINLPGGRTYYADSVKGRFTISRDNSKNTLYLQMNSLRAEDTAVYYCAKQTHGLTGYFDYWGQGTLVTVSS

SEQ ID NO: 434 - protein, 120 aa, Artificial Sequence
  Description of Artificial Sequence: Synthetic polypeptide
EVQLLESGGGLVQPGGSLRLSCAASGFTFGLYGMAWARQAPGKGLEWVSSIGMHGDTTYYADSVKGRFTISRDNSKNTLYLQMNSLRAEDTAVYYCAKVCGATYCNFDYWGQGTLVTVSS

SEQ ID NO: 435 - protein, 120 aa, Artificial Sequence
  Description of Artificial Sequence: Synthetic polypeptide
EVQLLESGGGLVQPGGSLRLSCAASGFTFGKYVMAWVRQAPGKGLEWVSIIDSLGSTTYYADSVKGRFTISRDNSKNTLYLQMNSLRAEDTAVYYCAKGGLLVHYDFDYWGQGTLVTVSS

SEQ ID NO: 436 - protein, 121 aa, Artificial Sequence
  Description of Artificial Sequence: Synthetic polypeptide
EVQLLESGGGLVQPGGSLRLSCAASGFTFEVYGMSWARQAPGKGLEWVSLIDAGGRNTYYADSVKGRFTISRDNSKNTLYLQMNSLRAEDTAVYYCAKSTTRAYSDYFDYWGQGTLVTVSS

SEQ ID NO: 437 - protein, 121 aa, Artificial Sequence
  Description of Artificial Sequence: Synthetic polypeptide
EVQLLESGGGLVQPGGSLRLSCAASGFTFENYDMHWVRQAPGKGLEWVSGITTHGRRTYYADSVKGRFTISRDNSKNTLYLQMNSLRAEDTAVYYCAKSDNLNMNVDFDYWGQGTLVTVSS

SEQ ID NO: 438 - protein, 121 aa, Artificial Sequence
  Description of Artificial Sequence: Synthetic polypeptide
EVQLLESGGGLVQPGGSLRLSCAASGFTFIKYDMCWARQAPGKGLEWVSCIESSGQNTYYADSVKGRFTISRDNSKNTLYLQMNSLRAEDTAVYYCAKCLNDSCNVHFDYWGQGTLVTVSS

SEQ ID NO: 439 - protein, 121 aa, Artificial Sequence
  Description of Artificial Sequence: Synthetic polypeptide
EVQLLESGGGLVQPGGSLRLSCAASGFTFGNYNMGWVRQAPGKGLEWVSDIGRYGRVTYYADSVKGRFTISRDNSKNTLYLQMNSLRAEDTAVYYCAKTQRMVNPSPFDYWGQGTLVTVSS

SEQ ID NO: 440 - protein, 123 aa, Artificial Sequence
  Description of Artificial Sequence: Synthetic polypeptide
EVQLLESGGGLVQPGGSLRLSCAASGFTFVSYSMGWVRQAPGKGLEWVSIISGQGTVTYYADSVKGRFTISRDNSKNTLYLQMNSLRAEDTAVYYCAKSPMVFALDGRSFDYWGQGTLVTVSS

SEQ ID NO: 441 - protein, 123 aa, Artificial Sequence
  Description of Artificial Sequence: Synthetic polypeptide
EVQLLESGGGLVQPGGSLRLSCTASGFTFSEYSMGWVRQAPGKGLEWVSSITPVGVFTYYADSVKGRFTISRDNSKNTLYLQMNSLRAEDTAVYYCAKGRPGPHGWSFRFDYWGQGTLVTVSS

SEQ ID NO: 442 - protein, 123 aa, Artificial Sequence
  Description of Artificial Sequence: Synthetic polypeptide
EVQLLESGGGLVQPGGSLRLSCAASGFTFGQYMMGWVRQAPGKGLEWVSTIDKSGYSTYYADSVKGRFTISRDNSKNTLYLQMNSLRAEDTAVYYCAKSGIDSRGLMTKFDYWGQGTLVTVSS

SEQ ID NO: 443 - protein, 123 aa, Artificial Sequence
  Description of Artificial Sequence: Synthetic polypeptide
EVQLLESGGGLVQPGGSLRLSCAASGFTFARYRMAWVRQAPGKGLEWVSSILSDGAVTYYADSVKGRFTISRDNSKNTLYLQMNSLRAEDTAVYYCAKPGGNAWSTRVTFDYWGQGTLVTVSS

SEQ ID NO: 444 - protein, 124 aa, Artificial Sequence
  Description of Artificial Sequence: Synthetic polypeptide
EVQLLESGGGLVQPGGSLRLSCAASGFTFTMYGMHWVRQAPGKGLEWVSSISQYGLSTYYADSVKGRFTISRDNSKNTLYLQMNSLRAEDTAVYYCAKGSMRRVFSSSDTFDYWGQGTLVTVSS

SEQ ID NO: 445 - protein, 116 aa, Artificial Sequence
  Description of Artificial Sequence: Synthetic polypeptide
EVQLLESGGGLVQPGGSLRLSCAASGFTFDSYDMNWVRQAPGKGLEWVSQISADGHFTYYADSVKGRFTISRDNSKNTLYLQMNSLRAEDTAVYYCAKSRSSFDYWGQGTLVTVSS

SEQ ID NO: 446 - protein, 116 aa, Artificial Sequence
  Description of Artificial Sequence: Synthetic polypeptide
EVQLLESGGGLVQPGGSLRLSCAASGFTFRDYMMGWVRQAPGKGLEWVSRIDSHGNRTYYADSVKGRFTISRDNSKNTLYLQMNSLRAEDTAVYYCAKHMTGFDYWGQGTLVTVSS

SEQ ID NO: 447 - protein, 116 aa, Artificial Sequence
  Description of Artificial Sequence: Synthetic polypeptide
EVQLLESGGGLVQPGGSLRLSCAASGFTFREYMMGWVRQAPGKGLEWVSRINGVGNSTYYADSVKGRFTISRDNSKNTLYLQMNSLRAEDTAVYYCAKHQVGFDYWGQGTLVTVSS

SEQ ID NO: 448 - protein, 116 aa, Artificial Sequence
  Description of Artificial Sequence: Synthetic polypeptide
EVQLLESGGGLVQPGGSLRLSCAASGFTFSDYMMGWVRQAPGKGLEWVSRITSEGSHTYYADSVKGRFTISRDNSKNTLYLQMNSLRAEDTAVYYCAKHTSGFDYWGQGTLVTVSS

SEQ ID NO: 449 - protein, 116 aa, Artificial Sequence
  Description of Artificial Sequence: Synthetic polypeptide
EVQLLESGGGLVQPGGSLRLSCAASGFTFGRYMMGWVRQAPGKGLEWVSRISGPGTVTYYADSVKGRFTISRDNSKNTLYLQMNSLRAEDTAVYYCAKHDTGFDYWGQGTLVTVSS

SEQ ID NO: 450 - protein, 116 aa, Artificial Sequence; identical to SEQ ID NO: 294
  Description of Artificial Sequence: Synthetic polypeptide

SEQ ID NO: 451 - protein, 116 aa, Artificial Sequence
  Description of Artificial Sequence: Synthetic polypeptide
EVQLLESGGGLVQPGGSLRLSCAASGFTFTSYGMQWVRQAPGKGLEWVSSISTDGMVTYYADSVKGRFTISRDNSKNTLYLQMNSLRAEDTAVYYCAKLGVNFDYWGQGTLVTVSS

SEQ ID NO: 452 - protein, 117 aa, Artificial Sequence
  Description of Artificial Sequence: Synthetic polypeptide
EVQLLESGGGLVQPGGSLRLSCAASGFTFGDYMMGWVRQAPGKGLEWVSIIRVPGSTTYYADSVKGRFTISRDNSKNTLYLQMNSLRAEDTAVYYCAKQKGDEFDYWGQGTLVTVSS

SEQ ID NO: 453 - protein, 117 aa, Artificial Sequence
  Description of Artificial Sequence: Synthetic polypeptide
EVQLLESGGGLVQPGGSLRLSCAASGFTFILYDMQWVRQAPGKGLEWVSRISANGHDTYYADSVKGRFTISRDNSKNTLYLQMNSLRAEDTAVYYCAKGPHYLFDYWGQGTLVTVSS

SEQ ID NO: 454 - protein, 117 aa, Artificial Sequence
  Description of Artificial Sequence: Synthetic polypeptide
EVQLLESGGGLVQPGGSLRLSCAASGFTFTKYFMGWVRQAPGKGLEWVSLIDPRGPHTYYADSVKGRFTISRDNSKNTLYLQMNSLRAEDTAVYYCAKQLGEEFDYWGQGTLVTVSS

SEQ ID NO: 455 - protein, 108 aa, Artificial Sequence
  Description of Artificial Sequence: Synthetic polypeptide
DIQMTQSPSSLSASVGDRVTITCRASQYIGTSLNWYQQKPGKAPKLLTYQASLLQSGVPSRFSGSGSGTDFTLTISSLQPEDFATYYCQQLALRPMTFGQGTKVEIKR

SEQ ID NO: 456 - protein, 108 aa, Artificial Sequence
  Description of Artificial Sequence: Synthetic polypeptide
DIQMTQSPSSLSASVGDRVTITCRASQSISHSLVWYQQKPGKAPKLLIYWASLLQSGVPSRFSGSGSGTDFTLTISSLQPEDFATYYCQQGMTTPFTFGQGTKVEIKR

SEQ ID NO: 457 - protein, 108 aa, Artificial Sequence; identical to SEQ ID NO: 455
  Description of Artificial Sequence: Synthetic polypeptide

SEQ ID NO: 458 - protein, 108 aa, Artificial Sequence
  Description of Artificial Sequence: Synthetic polypeptide
DIQMTQSPSSLSASVGDRVTITCRASQSIGTGLRWYQQKPGKAPMLLIYRASILQSGVPSRFSGSGSGTDFTLTISSLQPEDFATYYCQQTTLQPFTFSQGTKVEIKR

SEQ ID NO: 459 - protein, 108 aa, Artificial Sequence; identical to SEQ ID NO: 456
  Description of Artificial Sequence: Synthetic polypeptide

SEQ ID NO: 460 - protein, 108 aa, Artificial Sequence
  Description of Artificial Sequence: Synthetic polypeptide
DIQMTQSPSSLSASVGDRVTITCRASQNIGDRLHWYQQKPGKAPKLLIYRISRLQSGVPSRFSGSGSGTDFTLTISSLQPEDFATYYCQQFGLYPTTFGQGTKVEIKR

SEQ ID NO: 461 - protein, 116 aa, Artificial Sequence; identical to SEQ ID NO: 445
  Description of Artificial Sequence: Synthetic polypeptide

SEQ ID NO: 462 - protein, 116 aa, Artificial Sequence; identical to SEQ ID NO: 446
  Description of Artificial Sequence: Synthetic polypeptide

SEQ ID NO: 463 - protein, 116 aa, Artificial Sequence; identical to SEQ ID NO: 447
  Description of Artificial Sequence: Synthetic polypeptide

SEQ ID NO: 464 - protein, 116 aa, Artificial Sequence; identical to SEQ ID NO: 448
  Description of Artificial Sequence: Synthetic polypeptide

SEQ ID NO: 465 - protein, 116 aa, Artificial Sequence; identical to SEQ ID NO: 449
  Description of Artificial Sequence: Synthetic polypeptide

SEQ ID NO: 466 - protein, 116 aa, Artificial Sequence; identical to SEQ ID NO: 294
  Description of Artificial Sequence: Synthetic polypeptide

SEQ ID NO: 467 - protein, 116 aa, Artificial Sequence; identical to SEQ ID NO: 451
  Description of Artificial Sequence: Synthetic polypeptide

SEQ ID NO: 468 - protein, 117 aa, Artificial Sequence; identical to SEQ ID NO: 452
  Description of Artificial Sequence: Synthetic polypeptide

SEQ ID NO: 469 - protein, 117 aa, Artificial Sequence; identical to SEQ ID NO: 453
  Description of Artificial Sequence: Synthetic polypeptide

SEQ ID NO: 470 - protein, 117 aa, Artificial Sequence; identical to SEQ ID NO: 454
  Description of Artificial Sequence: Synthetic polypeptide

SEQ ID NO: 471 - protein, 123 aa, Artificial Sequence
  Description of Artificial Sequence: Synthetic polypeptide
  MOD_RES (33)..(33): Any amino acid
EVQLLESGGGLVQPGGSLRLSCAASGFTFFTYXMAWVRQAPGKGLEWVSSITPLGYNTYYADSVKGRFTISRDNSKNTLYLQMNSLRAEDTAVYYCAKPSDVKVSPLPSFDYWGRGTLVTVSS

SEQ ID NO: 472 - protein, 107 aa, Artificial Sequence
  Description of Artificial Sequence: Synthetic polypeptide
IQMTQSPSSLSASVGDRVTITCRASRPIWPFLEWYQQKPGKAPKLLIYFTSRLRAGVPSRFSGSGSGTDFTLTISSLQPEDFATYYCLQNVANPATFSQGTKVEIKR

SEQ ID NO: 473 - protein, 108 aa, Artificial Sequence
  Description of Artificial Sequence: Synthetic polypeptide
DIQMTQSPSSLSASVGDRVTITCRASRAIWPFLEWYQQKPGKAPKLLIYFTSRLAYGVPSRFSGSGSGTDFTLTISSLQPEDFATYYCLQNVANPATFSQGTKVEIKR

SEQ ID NO: 474 - protein, 108 aa, Artificial Sequence
  Description of Artificial Sequence: Synthetic polypeptide
DIQMTQSPSSLSASVGDRVTITCRASRAIWPFLEWYQQKPGKAPKLLIYFTSRLRQGVPSRFSGSGSGTDFTLTISSLQPEDFATYYCLQNVANPATFSQGTKVEIKR

SEQ ID NO: 475 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSRLARGVPSRFSGSGSGTDFTLTISSLQPEDFATYYCLQNVANPATFSQGTKVEIKR

SEQ ID NO: 476 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSRLRHGVPSRFSGSGSGTDFTLTISSLQPEDFATYYCLQNVANPATFSQGTKVEIKR

SEQ ID NO: 477 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSRLAAGVPSRFSGSGSGTDFTLTISSLQPEDFATYYCLQNVANPATFSQGTKVEIKR

SEQ ID NO: 478 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSRLRAGVPSRFSGSGSGTDFTLTISSLQPEDFATYYCLQNVQMPATFSQGTKVEIKR

SEQ ID NO: 479 - protein, 108 aa, Artificial Sequence
  Description of Artificial Sequence: Synthetic polypeptide
DIQMTQSPSSLSASVGDRVTITCRASRAIWPFLEWYQQKPGKAPKLLIYFTSRLAYGVPSRFSGSGSGTDFTLTISSLQPEDFATYYCLQNVQMPATFSQGTKVEIKR

SEQ ID NO: 480 - protein, 108 aa, Artificial Sequence
  Description of Artificial Sequence: Synthetic polypeptide
DIQMTQSPSSLSASVGDRVTITCRASRAIWPFLEWYQQKPGKAPKLLIYFTSRLRQGVPSRFSGSGSGTDFTLTISSLQPEDFATYYCLQNVQMPATFSQGTKVEIKR

SEQ ID NO: 481 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSRLARGVPSRFSGSGSGTDFTLTISSLQPEDFATYYCLQNVQMPATFSQGTKVEIKR

SEQ ID NO: 482 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSRLRHGVPSRFSGSGSGTDFTLTISSLQPEDFATYYCLQNVQMPATFSQGTKVEIKR

SEQ ID NO: 483 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSRLAAGVPSRFSGSGSGTDFTLTISSLQPEDFATYYCLQNVQMPATFSQGTKVEIKR

SEQ ID NO: 484 - protein, 11 aa, Artificial Sequence
  Description of Artificial Sequence: Synthetic peptide
RASRPIWPFLE

SEQ ID NO: 485 - protein, 7 aa, Artificial Sequence
  Description of Artificial Sequence: Synthetic peptide
FTSRLQS

SEQ ID NO: 486 - protein, 9 aa, Artificial Sequence
  Description of Artificial Sequence: Synthetic peptide
LQNVSMPAT

SEQ ID NO: 487 - protein, 11 aa, Artificial Sequence
  Description of Artificial Sequence: Synthetic peptide
RASQYIGSALS

SEQ ID NO: 488 - protein, 7 aa, Artificial Sequence
  Description of Artificial Sequence: Synthetic peptide
RASNLQS

SEQ ID NO: 489 - protein, 9 aa, Artificial Sequence
  Description of Artificial Sequence: Synthetic peptide
QQLAIRPFT

SEQ ID NO: 490 - protein, 11 aa, Artificial Sequence
  Description of Artificial Sequence: Synthetic peptide
RASRDIALDLL

SEQ ID NO: 491 - protein, 7 aa, Artificial Sequence
  Description of Artificial Sequence: Synthetic peptide
GWSGLQS

SEQ ID NO: 492 - protein, 20 aa, Artificial Sequence
  Description of Artificial Sequence: Synthetic peptide
AQGWGRPVTFGQGTKVEIKR

SEQ ID NO: 493 - protein, 11 aa, Artificial Sequence
  Description of Artificial Sequence: Synthetic peptide
RASQPIGHSLA

SEQ ID NO: 494 - protein, 7 aa, Artificial Sequence
  Description of Artificial Sequence: Synthetic peptide
WASTLQS

SEQ ID NO: 495 - protein, 9 aa, Artificial Sequence
  Description of Artificial Sequence: Synthetic peptide
QQMLRTPFT

SEQ ID NO: 496 - protein, 11 aa, Artificial Sequence
  Description of Artificial Sequence: Synthetic peptide
RASQRIGSNLA

SEQ ID NO: 497 - protein, 7 aa, Artificial Sequence
  Description of Artificial Sequence: Synthetic peptide
WASLLQS

SEQ ID NO: 498 - protein, 9 aa, Artificial Sequence
  Description of Artificial Sequence: Synthetic peptide
QQTRSAPFT

SEQ ID NO: 499 - protein, 11 aa, Artificial Sequence
  Description of Artificial Sequence: Synthetic peptide
RASQSIGHSLV

SEQ ID NO: 500 - protein, 7 aa, Artificial Sequence
  Description of Artificial Sequence: Synthetic peptide
WASLLQS

SEQ ID NO: 501 - protein, 20 aa, Artificial Sequence
  Description of Artificial Sequence: Synthetic peptide
QQSRAAPFTFGQGTKVEIKR

SEQ ID NO: 502 - protein, 11 aa, Artificial Sequence
  Description of Artificial Sequence: Synthetic peptide
RASQYIGTALN

SEQ ID NO: 503 - protein, 7 aa, Artificial Sequence
  Description of Artificial Sequence: Synthetic peptide
RRSHLQS

SEQ ID NO: 504 - protein, 9 aa, Artificial Sequence
  Description of Artificial Sequence: Synthetic peptide
QQIALTPYT

SEQ ID NO: 505 - protein, 11 aa, Artificial Sequence
  Description of Artificial Sequence: Synthetic peptide
RASQPIGSVLA

SEQ ID NO: 506 - protein, 7 aa, Artificial Sequence
  Description of Artificial Sequence: Synthetic peptide
FSSILQS

SEQ ID NO: 507 - protein, 9 aa, Artificial Sequence
  Description of Artificial Sequence: Synthetic peptide
QQALRSPFT

SEQ ID NO: 508 - protein, 11 aa, Artificial Sequence
  Description of Artificial Sequence: Synthetic peptide
RASQYIGTSLA

SEQ ID NO: 509 - protein, 7 aa, Artificial Sequence
  Description of Artificial Sequence: Synthetic peptide
HSSGLQS

SEQ ID NO: 510 - protein, 9 aa, Artificial Sequence
  Description of Artificial Sequence: Synthetic peptide
QQTALRPFT

SEQ ID NO: 511 - protein, 11 aa, Artificial Sequence
  Description of Artificial Sequence: Synthetic peptide
RASQHINASLG

SEQ ID NO: 512 - protein, 7 aa, Artificial Sequence
  Description of Artificial Sequence: Synthetic peptide
WASQLQS

SEQ ID NO: 513 - protein, 9 aa, Artificial Sequence
  Description of Artificial Sequence: Synthetic peptide
QQMVRTPFT

SEQ ID NO: 514 - protein, 11 aa, Artificial Sequence
  Description of Artificial Sequence: Synthetic peptide
RASQSIYPFLE

SEQ ID NO: 515 - protein, 7 aa, Artificial Sequence
  Description of Artificial Sequence: Synthetic peptide
FTSRLQS

SEQ ID NO: 516 - protein, 9 aa, Artificial Sequence
  Description of Artificial Sequence: Synthetic peptide
QQNATNPAT

SEQ ID NO: 517 - protein, 5 aa, Artificial Sequence
  Description of Artificial Sequence: Synthetic peptide
SANMS

SEQ ID NO: 518 - protein, 17 aa, Artificial Sequence
  Description of Artificial Sequence: Synthetic peptide
WIEAPGVQTFYADSVRG

SEQ ID NO: 519 - protein, 11 aa, Artificial Sequence
  Description of Artificial Sequence: Synthetic peptide
SPFGPLYGFDY

SEQ ID NO: 520 - protein, 5 aa, Artificial Sequence
  Description of Artificial Sequence: Synthetic peptide
SANMS

SEQ ID NO: 521 - protein, 17 aa, Artificial Sequence
  Description of Artificial Sequence: Synthetic peptide
WIEASGVQTFYADSVKG

SEQ ID NO: 522 - protein, 11 aa, Artificial Sequence
  Description of Artificial Sequence: Synthetic peptide
SPFGPLYGFDY

SEQ ID NO: 523 - protein, 5 aa, Artificial Sequence
  Description of Artificial Sequence: Synthetic peptide
TYKMV

SEQ ID NO: 524 - protein, 17 aa, Artificial Sequence
  Description of Artificial Sequence: Synthetic peptide
SIGPGGLDTYYADSVKG

SEQ ID NO: 525 - protein, 12 aa, Artificial Sequence
  Description of Artificial Sequence: Synthetic peptide
SWMTLPITGFDY

SEQ ID NO: 526 - protein, 5 aa, Artificial Sequence
  Description of Artificial Sequence: Synthetic peptide
LYEMA

SEQ ID NO: 527 - protein, 17 aa, Artificial Sequence
  Description of Artificial Sequence: Synthetic peptide
SIMSNGIRTYYADSVKG

SEQ ID NO: 528 - protein, 12 aa, Artificial Sequence
  Description of Artificial Sequence: Synthetic peptide
RKSSSSRTVFDY

SEQ ID NO: 529 - protein, 5 aa, Artificial Sequence
  Description of Artificial Sequence: Synthetic peptide
SANMT

SEQ ID NO: 530 - protein, 17 aa, Artificial Sequence
  Description of Artificial Sequence: Synthetic peptide
WIDDTGTQTYYADSVKG

SEQ ID NO: 531 - protein, 11 aa, Artificial Sequence
  Description of Artificial Sequence: Synthetic peptide
SPFGPLYGFDY

SEQ ID NO: 532 - protein, 108 aa, Artificial Sequence
  Description of Artificial Sequence: Synthetic polypeptide
DIQMTQSPSSLSASVGDRVTITCRASRNIWPFLEWYQQKPGKAPKLLIYFTSRLRHGVPSRFSGSGSGTDFTLTISSLQPEDFATYYCLQNVANPATFSQGTKVEIKR

SEQ ID NO: 533 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSRLRHGVPSRFSGSGSGTDFTLTISSLQPEDFATYYCLQNVANPATFAQGTKVEIKR

SEQ ID NO: 534 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSRLRHGVPSRFSGSGSGTDFTLTISSLQPEDFATYYCLQNVANPATFTQGTKVEIKR

SEQ ID NO: 535 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSRLRHGVPSRFSGSGSGTDFTLTISSLQPEDFATYYCLQNVANPATFPQGTKVEIKR

SEQ ID NO: 536 - protein, 108 aa, Artificial Sequence
  Description of Artificial Sequence: Synthetic polypeptide
DICMTQSPSSLSASVGDRVTITCRASRPIWPFLEWYQQKPGKAPKLLIYFTSRLRHGVPSRFSGSGSGTDFTLTISSLQPEDFATYYCLQNVANPATFSQGTKVEIKR

SEQ ID NO: 537 - protein, 108 aa, Artificial Sequence
  Description of Artificial Sequence: Synthetic polypeptide
DIQMTQSPCSLSASVGDRVTITCRASRPIWPFLEWYQQKPGKAPKLLIYFTSRLRHGVPSRFSGSGSGTDFTLTISSLQPEDFATYYCLQNVANPATFSQGTKVEIKR

SEQ ID NO: 538 - protein, 108 aa, Artificial Sequence
  Description of Artificial Sequence: Synthetic polypeptide
DIQMTQSPSSLSASVGDCVTITCRASRPIWPFLEWYQQKPGKAPKLLIYFTSRLRHGVPSRFSGSGSGTDFTLTISSLQPEDFATYYCLQNVANPATFSQGTKVEIKR

SEQ ID NO: 539 - protein, 108 aa, Artificial Sequence
  Description of Artificial Sequence: Synthetic polypeptide
DIQMTQSPSSLSASVGDRVTITCRASRPIWPFLEWYQQKPCKAPKLLIYFTSRLRHGVPSRFSGSGSGTDFTLTISSLQPEDFATYYCLQNVANPATFSQGTKVEIKR

SEQ ID NO: 540 - protein, 108 aa, Artificial Sequence
  Description of Artificial Sequence: Synthetic polypeptide
DIQMTQSPSSLSASVGDRVTITCRASRPIWPFLEWYQQKPGCAPKLLIYFTSRLRHGVPSRFSGSGSGTDFTLTISSLQPEDFATYYCLQNVANPATFSQGTKVEIKR

SEQ ID NO: 541 - protein, 108 aa, Artificial Sequence
  Description of Artificial Sequence: Synthetic polypeptide
DIQMTQSPSSLSASVGDRVTITCRASRPIWPFLEWYQQKPGKAPCLLIYFTSRLRHGVPSRFSGSGSGTDFTLTISSLQPEDFATYYCLQNVANPATFSQGTKVEIKR

SEQ ID NO: 542 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSRLRHGVPCRFSGSGSGTDFTLTISSLQPEDFATYYCLQNVANPATFSQGTKVEIKR

SEQ ID NO: 543 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSRLRHGVPSRFSGSGSGTCFTLTISSLQPEDFATYYCLQNVANPATFSQGTKVEIKR

SEQ ID NO: 544 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSRLRHGVPSRFSGSGSGTDFTLCISSLQPEDFATYYCLQNVANPATFSQGTKVEIKR

SEQ ID NO: 545 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSRLRHGVPSRFSGSGSGTDFTLTISSLCPEDFATYYCLQNVANPATFSQGTKVEIKR

SEQ ID NO: 546 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSRLRHGVPSRFSGSGSGTDFTLTISSLQPEDFATYYCLQNVANPATFSQGTCVEIKR

SEQ ID NO: 547 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSRLAAGVPSRFSGSGSGTDFTLTISSLQPEDFATYYCLQNVANPATFPQGTKVEIKR

SEQ ID NO: 548 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSRLAAGVPSRFSGSGSGTDFTLTISSLQPEDFATYYCLQNVANPATFFQGTKVEIKR

SEQ ID NO: 549 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSRLAAGVPSRFSGSGSGTDFTLTISSLQPEDFATYYCLQNVANPATFQQGTKVEIKR

SEQ ID NO: 550 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSRLAAGVPSRFSGSGSGTDFTLTISSLQPEDFATYYCLQNVANPATFVQGTKVEIKR

SEQ ID NO: 551 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSRLAAGVPSRFSGSGSGTDFTLTISSLQPEDFATYYCLQNVANPATFAQGTKVEIKR

SEQ ID NO: 552 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSRLAAGVPSRFSGSGSGTDFTLTISSLQPEDFATYYCLQNVANPATFIQGTKVEIKR

SEQ ID NO: 553 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSRLAAGVPSRFSGSGSGTDFTLTISSLQPEDFATYYCLQNVANPATFTQGTKVEIKR

SEQ ID NO: 554 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSRLAAGVPSRFSGSGSGTDFTLTISSLQPEDFATYYCLQNVANPATFMQGTKVEIKR

SEQ ID NO: 555 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSRLAAGVPSRFSGSGSGTDFTLTISSLQPEDFATYYCLQNVANPATFDQGTKVEIKR

SEQ ID NO: 556 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSRLAAGVPSRFSGSGSGTDFTLTISSLQPEDFATYYCLQNVANPATFYQGTKVEIKR

SEQ ID NO: 557 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSRLAAGVPSRFSGSGSGTDFTLTISSLQPEDFATYYCLQNLANPATFSQGTKVEIKR

SEQ ID NO: 558 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSRLAAGVPSRFSGSGSGTDFTLTISSLQPEDFATYYCLQNTANPATFSQGTKVEIKR

SEQ ID NO: 559 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSRLAAGVPSRFSGSGSGTDFTLTISSLQPEDFATYYCLQNAANPATFSQGTKVEIKR

SEQ ID NO: 560 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSRLAAGVPSRFSGSGSGTDFTLTISSLQPEDFATYYCIQNVANPATFSQGTKVEIKR

SEQ ID NO: 561 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSRLAAGVPSRFSGSGSGTDFTLTISSLQPEDFATYYCHQNVANPATFSQGTKVEIKR

SEQ ID NO: 562 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSRLAAGVPSRFSGSGSGTDFTLTISSLQPEDFATYYCFQNVANPATFSQGTKVEIKR

SEQ ID NO: 563 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSRLAAGVPSRFSGSGSGTDFTLTISSLQPEDFATYYCMQNVANPATFSQGTKVEIKR

SEQ ID NO: 564 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSYLAAGVPSRFSGSGSGTDFTLTISSLQPEDFATYYCLQNVANPATFSQGTKVEIKR

SEQ ID NO: 565 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSQLAAGVPSRFSGSGSGTDFTLTISSLQPEDFATYYCLQNVANPATFSQGTKVEIKR

SEQ ID NO: 566 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSELAAGVPSRFSGSGSGTDFTLTISSLQPEDFATYYCLQNVANPATFSQGTKVEIKR

SEQ ID NO: 567 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSILAAGVPSRFSGSGSGTDFTLTISSLQPEDFATYYCLQNVANPATFSQGTKVEIKR

SEQ ID NO: 568 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSTLAAGVPSRFSGSGSGTDFTLTISSLQPEDFATYYCLQNVANPATFSQGTKVEIKR

SEQ ID NO: 569 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSSLAAGVPSRFSGSGSGTDFTLTISSLQPEDFATYYCLQNVANPATFSQGTKVEIKR

SEQ ID NO: 570 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSDLAAGVPSRFSGSGSGTDFTLTISSLQPEDFATYYCLQNVANPATFSQGTKVEIKR

SEQ ID NO: 571 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSMLAAGVPSRFSGSGSGTDFTLTISSLQPEDFATYYCLQNVANPATFSQGTKVEIKR

SEQ ID NO: 572 - protein, 108 aa, Artificial Sequence
  Description of Artificial Sequence: Synthetic polypeptide
DIQMTQSPSSLSASVGDRVTITCRASRWIWPFLEWYQQKPGKAPKLLIYFTSRLAAGVPSRFSGSGSGTDFTLTISSLQPEDFATYYCLQNVANPATFSQGTKVEIKR

SEQ ID NO: 573 - protein, 108 aa, Artificial Sequence
  Description of Artificial Sequence: Synthetic polypeptide
DIQMTQSPSSLSASVGDRVTITCRASRRIWPFLEWYQQKPGKAPKLLIYFTSRLAAGVPSRFSGSGSGTDFTLTISSLQPEDFATYYCLQNVANPATFSQGTKVEIKR

SEQ ID NO: 574 - protein, 108 aa, Artificial Sequence
  Description of Artificial Sequence: Synthetic polypeptide
DIQMTQSPSSLSASVGDRVTITCRASREIWPFLEWYQQKPGKAPKLLIYFTSRLAAGVPSRFSGSGSGTDFTLTISSLQPEDFATYYCLQNVANPATFSQGTKVEIKR

SEQ ID NO: 575 - protein, 108 aa, Artificial Sequence
  Description of Artificial Sequence: Synthetic polypeptide
DIQMTQSPSSLSASVGDRVTITCRASRTIWPFLEWYQQKPGKAPKLLIYFTSRLAAGVPSRFSGSGSGTDFTLTISSLQPEDFATYYCLQNVANPATFSQGTKVEIKR

SEQ ID NO: 576 - protein, 108 aa, Artificial Sequence
  Description of Artificial Sequence: Synthetic polypeptide
DIQMTQSPSSLSASVGDRVTITCRASRSIWPFLEWYQQKPGKAPKLLIYFTSRLAAGVPSRFSGSGSGTDFTLTISSLQPEDFATYYCLQNVANPATFSQGTKVEIKR

SEQ ID NO: 577 - protein, 108 aa, Artificial Sequence
  Description of Artificial Sequence: Synthetic polypeptide
DIQMTQSPSSLSASVGDRVTITCRASRAIWPFLEWYQQKPGKAPKLLIYFTSRLAAGVPSRFSGSGSGTDFTLTISSLQPEDFATYYCLQNVANPATFSQGTKVEIKR

SEQ ID NO: 578 - protein, 108 aa, Artificial Sequence
  Description of Artificial Sequence: Synthetic polypeptide
DIQMTQSPSSLSASVGDRVTITCRASRDIWPFLEWYQQKPGKAPKLLIYFTSRLAAGVPSRFSGSGSGTDFTLTISSLQPEDFATYYCLQNVANPATFSQGTKVEIKR

SEQ ID NO: 579 - protein, 108 aa, Artificial Sequence
  Description of Artificial Sequence: Synthetic polypeptide
DIQMTQSPSSLSASVGDRVTITCRASRFIWPFLEWYQQKPGKAPKLLIYFTSRLAAGVPSRFSGSGSGTDFTLTISSLQPEDFATYYCLQNVANPATFSQGTKVEIKR

SEQ ID NO: 580 - protein, 108 aa, Artificial Sequence
  Description of Artificial Sequence: Synthetic polypeptide
DIQMTQSPSSLSASVGDRVTITCRASRNIWPFLEWYQQKPGKAPKLLIYFTSRLAAGVPSRFSGSGSGTDFTLTISSLQPEDFATYYCLQNVANPATFSQGTKVEIKR

SEQ ID NO: 581 - protein, 108 aa, Artificial Sequence
  Description of Artificial Sequence: Synthetic polypeptide
DIQMTQSPSSLSASVGDRVTITCRASRKIWPFLEWYQQKPGKAPKLLIYFTSRLAAGVPSRFSGSGSGTDFTLTISSLQPEDFATYYCLQNVANPATFSQGTKVEIKR

SEQ ID NO: 582 - protein, 108 aa, Artificial Sequence
  Description of Artificial Sequence: Synthetic polypeptide
DIQMTQSPSSLSASVGDRVTITCRASRYIWPFLEWYQQKPGKAPKLLIYFTSRLAAGVPSRFSGSGSGTDFTLTISSLQPEDFATYYCLQNVANPATFSQGTKVEIKR

SEQ ID NO: 583 - protein, 108 aa, Artificial Sequence
  Description of Artificial Sequence: Synthetic polypeptide
DIQMTQSPSSLSASVGDRVTITCRASRPIWPFLEWYQQKPGKAPKLLIYFTSRLAAGVPSRFSGSGSGTDFTLTISSLQPEDFATYYCLQNIANPATFSQGTKVEIKR

SEQ ID NO: 584 - protein, 108 aa, Artificial Sequence
  Description of Artificial Sequence: Synthetic polypeptide
DIQMTQSPSSLSASVGDRVTITCRGSRTIWPFLEWYQQKPGKAPKLLIYFTSRLAAGVPSRFSGSGSGTDFTLTISSLQPEDFATYYCLQNVANPATFPQGTKVEIKR

SEQ ID NO: 585 - protein, 108 aa, Artificial Sequence
  Description of Artificial Sequence: Synthetic polypeptide
DIQMTQSPSSLSASVGDRVTITCRASRSIWPFLEWYQQKPGKAPKLLIYFTSTLAAGVPSRFSGSGSGTDFTLTISSLQPEDFATYYCLQNVANPATFTQGTKVEIKR

SEQ ID NO: 586 - protein, 108 aa, Artificial Sequence
  Description of Artificial Sequence: Synthetic polypeptide
DIQMTQSPSSLSASVGDRVTITCRASRNIWPFLEWYQQKPGKAPKLLIYFTSRLAAGVPSRFSGSGSGTDFTLTISSLQPEDFATYYCLQNVANPATFTQGTKVEIKR

SEQ ID NO: 587 - protein, 108 aa, Artificial Sequence
  Description of Artificial Sequence: Synthetic polypeptide
DIQMTQSPSSLSASVGDRVTITCRASRSIWPFLEWYQQKPGKAPKLLIYFTSRLAAGVPSRFSGSGSGTDFTLTISSLQPEDFATYYCLQNVANPATFAQGTKVEIKR

SEQ ID NO: 588 - protein, 108 aa, Artificial Sequence
  Description of Artificial Sequence: Synthetic polypeptide
DIQMTQSPSSLSASVGDRVTITCRASRSIWPFLEWYQQKPGKAPKLLIYFTSRLAAGVPSRFSGSGSGTDFTLTISSLQPEDFATYYCLQNVANPATFPQGTKVEIKR

SEQ ID NO: 589 - protein, 108 aa, Artificial Sequence
  Description of Artificial Sequence: Synthetic polypeptide
DIQMTQSPSSLSASVGDRVTITCRASRNIWPFLEWYQQKPGKAPKLLIYFTSRLAAGVPSRFSGSGSGTDFTLTISSLQPEDFATYYCLQNVANPATFAQGTKVEIKR

SEQ ID NO: 590 - protein, 108 aa, Artificial Sequence
  Description of Artificial Sequence: Synthetic polypeptide
DIQMTQSPSSLSASVGDRVTITCRASRNIWPFLEWYQQKPGKAPKLLIYFTSRLAAGVPSRFSGSGSGTDFTLTISSLQPEDFATYYCLQNVANPATFPQGTKVEIKR

SEQ ID NO: 591 - protein, 108 aa, Artificial Sequence
  Description of Artificial Sequence: Synthetic polypeptide
DIQMTQSPSSLSASVGDRVTITCRASRSIWPFLEWYQQKPGKAPKLLIYFTSTLAAGVPSRFSGSGSGTDFTLTISSLQPEDFATYYCLQNVANPATFAQGTKVEIKR

SEQ ID NO: 592 - protein, 108 aa, Artificial Sequence
  Description of Artificial Sequence: Synthetic polypeptide
DIQMTQSPSSLSASVGDRVTITCRASRTIWPFLEWYQQKPGKAPKLLIYFTSRLAAGVPSRFSGSGSGTDFTLTISSLQPEDFATYYCLQNVANPATFAQGTKVEIKR

SEQ ID NO: 593 - protein, 108 aa, Artificial Sequence; identical to SEQ ID NO: 588
  Description of Artificial Sequence: Synthetic polypeptide

SEQ ID NO: 594 - protein, 108 aa, Artificial Sequence
  Description of Artificial Sequence: Synthetic polypeptide
DIQMTQSPSSLSASVGDRVTITCRASRSIWPFLEWYQQKPGKAPKLLIYFTSRLAAGVPSRFSGSGSGTDFTLTISSLQPEDFATYYCLQNVANPATFTQGTKVEIKR

SEQ ID NO: 595 - protein, 108 aa, Artificial Sequence
  Description of Artificial Sequence: Synthetic polypeptide
DIQMTQSPSSLSASVGDRVTITCRASRNIWPFLEWYQQKPGKAPKLLIYFTSTLAAGVPSRFSGSGSGTDFTLTISSLQPEDFATYYCLQNVANPATFPQGTKVEIKR

SEQ ID NO: 596 - protein, 108 aa, Artificial Sequence
  Description of Artificial Sequence: Synthetic polypeptide
DIQMTQSPSSLSASVGDRVTITCRASRSIWPFLEWYQQKPGKAPKLLIYFTSTLAAGVPSRFSGSGSGTDFTLTISSLQPEDFATYYCLQNVANPATFPQGTKVEIKR

SEQ ID NO: 597 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEAPGVQTYYADSVRGRFTISRDNSKNTLYLQMNSLRAEDTAVYYCARSPFGPLYGFDYRGQGTLVTVSS

SEQ ID NO: 598 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEAPGVQTFYADSVSGRFTISRDNSKNTLYLQMNSLRAEDTAVYYCARSPFGPLYGFDYRGQGTLVTVSS

SEQ ID NO: 599 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEAPGVQTFYADSVQGRFTISRDNSKNTLYLQMNSLRAEDTAVYYCARSPFGPLYGFDYRGQGTLVTVSS

SEQ ID NO: 600 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEAPGVQTFYADSVKGRFTISRDNSKNTLYLQMNSLRAEDTAVYYCARSPFGPLYGFDYRGQGTLVTVSS

SEQ ID NO: 601 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEAPGVQTFYADSVHGRFTISRDNSKNTLYLQMNSLRAEDTAVYYCARSPFGPLYGFDYRGQGTLVTVSS

SEQ ID NO: 602 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEAPGVQTFYADSVFGRFTISRDNSKNTLYLQMNSLRAEDTAVYYCARSPFGPLYGFDYRGQGTLVTVSS

SEQ ID NO: 603 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEAPGVQTFYADSVLGRFTISRDNSKNTLYLQMNSLRAEDTAVYYCARSPFGPLYGFDYRGQGTLVTVSS

SEQ ID NO: 604 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEAPGVQTFYADSVPGRFTISRDNSKNTLYLQMNSLRAEDTAVYYCARSPFGPLYGFDYRGQGTLVTVSS

SEQ ID NO: 605 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEAPGVQTFYADSVRGRFTISRDNSKNTLYLQMNSLRAEDTAVYYCARSPAGPLYGFDYRGQGTLVTVSS

SEQ ID NO: 606 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEAPGVQTFYADSVRGRFTISRDNSKNTLYLQMNSLRAEDTAVYYCARSPWGPLYGFDYRGQGTLVTVSS

SEQ ID NO: 607 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEAPGVQTFYADSVRGRFTISRDNSKNTLYLQMNSLRAEDTAVYYCARSPEGPLYGFDYRGQGTLVTVSS

SEQ ID NO: 608 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEAPGVQTFYADSVRGRFTISRDNSKNTLYLQMNSLRAEDTAVYYCARSPSGPLYGFDYRGQGTLVTVSS

SEQ ID NO: 609 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEAPGVQTFYADSVRGRFTISRDNSKNTLYLQMNSLRAEDTAVYYCARSPGGPLYGFDYRGQGTLVTVSS

SEQ ID NO: 610 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEAPGVQTFYADSVRGRFTISRDNSKNTLYLQMNSLRAEDTAVYYCARSPKGPLYGFDYRGQGTLVTVSS

SEQ ID NO: 611 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEAPGVQTFYADSVRGRFTISRDNSKNTLYLQMNSLRAEDTAVYYCARSPFGTLYGFDYRGQGTLVTVSS

SEQ ID NO: 612 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEAPGVQTFYADSVRGRFTISRDNSKNTLYLQMNSLRAEDTAVYYCARSPFGALYGFDYRGQGTLVTVSS

SEQ ID NO: 613 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEAPGVQTFYADSVRGRFTISRDNSKNTLYLQMNSLRAEDTAVYYCARSPFGELYGFDYRGQGTLVTVSS

SEQ ID NO: 614 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEAPGVQTFYADSVRGRFTISRDNSKNTLYLQMNSLRAEDTAVYYCARSPFGRLYGFDYRGQGTLVTVSS

SEQ ID NO: 615 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEAPGVQTFYADSVRGRFTISRDNSKNTLYLQMNSLRAEDTAVYYCARSPFGFLYGFDYRGQGTLVTVSS

SEQ ID NO: 616 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEAPGVQTFYADSVRGRFTISRDNSKNTLYLQMNSLRAEDTAVYYCARSPFGPLYGFDYTGQGTLVTVSS

SEQ ID NO: 617 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEAPGVQTFYADSVRGRFTISRDNSKNTLYLQMNSLRAEDTAVYYCARSPFGPLYGFDYVGQGTLVTVSS

SEQ ID NO: 618 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEAPGVQTFYADSVRGRFTISRDNSKNTLYLQMNSLRAEDTAVYYCARSPFGPLYGFDYLGQGTLVTVSS

SEQ ID NO: 619 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEAPGVQTFYADSVRGRFTISRDNSKNTLYLQMNSLRAEDTAVYYCARSPFGPLYGFDYWGQGTLVTVSS

SEQ ID NO: 620 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEAPGVQTFYADSVRGRFTISRDNSKNTLYLQMNSLRAEDTAVYYCARSPFGPLYGFDYFGQGTLVTVSS

SEQ ID NO: 621 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEAPGVQTFYADSVRGRFTISRDNSKNTLYLQMNSLRAEDTAVYYCARSPFGPLYGFDYSGQGTLVTVSS

SEQ ID NO: 622 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEAPGVQTFYADSVRGRFTISRDNSKNTLYLQMNSLRAEDTAVYYCARSPFGPLYGFDYMGQGTLVTVSS

SEQ ID NO: 623 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEAPGVQTFYADSVRGRFTISRDNSKNTLYLQMNSLRAEDTAVYYCARSPFGPLYGFDYKGQGTLVTVSS

SEQ ID NO: 624 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEAPGVQTFYADSVRGRFTISRDNSKNTLYLQMNSLRAEDTAVYYCARSPFGPLYGFDYHGQGTLVTVSS

SEQ ID NO: 625 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEAPGVQTFYADSVRGRFTISRDNSKNTLYLQMNSLRAEDTAVYYCARSPFGPLYGFDYIGQGTLVTVSS

SEQ ID NO: 626 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEAPGVQTFYADSVRGRFTISRDNSKNTLYLQMNSLRAEDTAVYYCARSPLGPLYGFDYRGQGTLVTVSS

SEQ ID NO: 627 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEAPGVQTFYADSVRGRFTISRDNSKNTLYLQMNSLRAEDTAVYYCARSPRGPLYGFDYRGQGTLVTVSS

SEQ ID NO: 628 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEAPGVQTFYADSVRGRFTISRDNSKNTLYLQMNSLRAEDTAVYYCARSPFGPLYGFDYYGQGTLVTVSS

SEQ ID NO: 629 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEAPGVQTFYADSVRGRFTISRDNSKNTLYLQMNSLRAEDTAVYYCARSPFGPLYGFDYQGQGTLVTVSS

SEQ ID NO: 630 - protein, 120 aa, Artificial Sequence; identical to SEQ ID NO: 627
  Description of Artificial Sequence: Synthetic polypeptide

SEQ ID NO: 631 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEAPGVQTFYADSVRGRFTISRDNSKNTLYLQMNSLRAEDTAVYYCARLPMGILYGFDYRGQGTLVTVSS

SEQ ID NO: 632 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEAPGVQTFYADSVRGRFTISRDNSKNTLYLQMNSLRAEDTAVYYCARSPHGPLYGFDYRGQGTLVTVSS

SEQ ID NO: 633 - protein, 120 aa, Artificial Sequence
  Description of Artificial Sequence: Synthetic polypeptide
EVQLLESGGGLVQPGGSLRLSCAASGFTFDSANMSWARQAPGKGLEWVSWIEAPGVQTFYADSVRGRFTISRDNSKNTLYLQMNSLRAEDTAVYYCARSPMGPLYGFDYRGQGTLVTVSS

SEQ ID NO: 634 - protein, 120 aa, Artificial Sequence; identical to SEQ ID NO: 612
  Description of Artificial Sequence: Synthetic polypeptide

SEQ ID NO: 635 - protein, 120 aa, Artificial Sequence; identical to SEQ ID NO: 610
  Description of Artificial Sequence: Synthetic polypeptide

SEQ ID NO: 636 - protein, 11 aa, Artificial Sequence
  Description of Artificial Sequence: Synthetic peptide
RASRPIWPFLE

SEQ ID NO: 637 - protein, 7 aa, Artificial Sequence
  Description of Artificial Sequence: Synthetic peptide
FTSRLRH

SEQ ID NO: 638 - protein, 9 aa, Artificial Sequence
  Description of Artificial Sequence: Synthetic peptide
LQNVANPAT

SEQ ID NO: 639 - protein, 6 aa, Homo sapiens
MYPPPY

SEQ ID NO: 640 - protein, 120 aa, Artificial Sequence
  Description of Artificial Sequence: Synthetic polypeptide
EVQLLESGGGLVQPGGSLRLSCAASGFTFMRANMSWVRQAPGKGLEWVSWIEDTGTQTFYADSVKGRFTISRDNSKNTLYLQMNSLRAEDTAVYYCAKSPFGPLYGFDYRGQGTLVTVSS

SEQ ID NO: 641 - protein, 98 aa, Homo sapiens
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAK

SEQ ID NO: 642 - DNA, 287 bp, Homo sapiens
gacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcc

SEQ ID NO: 643 - protein, 95 aa, Homo sapiens
DIQMTQSPSSLSASVGDRVTITCRASQSISSYLNWYQQKPGKAPKLLIYAASSLQSGVPSRFSGSGSGTDFTLTISSLQPEDFATYYCQQSYSTP

SEQ ID NO: 644 - protein, 6 aa, Artificial Sequence
  Description of Artificial Sequence: Synthetic 6xHis tag
HHHHHH

What is claimed is:

1. An isolated antibody polypeptide that binds the same epitope as domain antibody (dAb) 1h-239-891(D70C) (SEQ ID NO: 543), wherein said antibody polypeptide comprises a variable domain having a binding specificity to CD28 and at least 90% sequence identity to the amino acid sequence of dAb 1h-239-891(D70C) (SEQ ID NO: 543).

2. The antibody polypeptide of claim 1, wherein the antibody polypeptide is 1h-239-891(D70C) (SEQ ID NO: 543).

3. The antibody polypeptide of claim 1, wherein the antibody polypeptide comprises a first single variable domain having a binding specificity to a first antigen and a second single variable domain having a binding specificity to a second antigen, wherein the first antigen is CD28, and wherein the second antigen is an antigen to other than CD28.

4. The antibody polypeptide of claim 3, wherein the second antigen is an antigen presenting cell surface antigen or a T cell surface antigen.

5. The antibody of claim 3, wherein the second antigen is a cytokine.

6. A pharmaceutical composition comprising a therapeutically-effective amount of an antibody polypeptide of claim 1 and a pharmaceutically acceptable carrier.

7. The pharmaceutical composition of claim 6, further comprising an immunosuppressive/immunomodulatory and/or anti-inflammatory agent.

8. A method of treating or alleviating an autoimmune disease in a human individual in need of such treatment, comprising administering to the individual a therapeutically effective amount of the pharmaceutical composition of claim 6, wherein the autoimmune disease is treated or alleviated.

9. The method of claim 8, wherein the pharmaceutical composition is administered in combination with an immunosuppressive/immunomodulatory and/or anti-inflammatory agent.

10. The antibody polypeptide of claim 1, wherein said antibody polypeptide comprises a variable domain having at least 95% sequence identity to the amino acid sequence of dAb 1h-239-891(D70C) (SEQ ID NO: 543).

11. The antibody polypeptide of claim 10, wherein said antibody polypeptide comprises a variable domain having the amino acid sequence of dAb 1h-239-891(D70C) (SEQ ID NO: 543).

12. The antibody polypeptide of claim 1, wherein said antibody polypeptide comprises a variable domain that has a binding specificity to CD28 and that differs from the amino acid sequence of dAb 1h-239-891(D70C) (SEQ ID NO: 543) by 10 or fewer amino acid positions.

13. The antibody polypeptide of claim 1, wherein said antibody polypeptide comprises a variable domain that has a binding specificity to CD28 and that differs from the amino acid sequence of dAb 1h-239-891(D70C) (SEQ ID NO: 543) by 5 or fewer amino acid positions.

* * * * *

UNITED STATES PATENT AND TRADEMARK OFFICE
CERTIFICATE OF CORRECTION

PATENT NO. : 8,168,759 B2
APPLICATION NO. : 12/505166
DATED : May 1, 2012
INVENTOR(S) : Murray McKinnon It is certified that error appears in the above-identified patent and that said Letters Patent is hereby corrected as shown below:

Claim 5, column 219, lines 50-51 should read as follows:

The antibody polypeptide of claim 3, wherein the second antigen is a cytokine.

Signed and Sealed this
Nineteenth Day of March, 2013

Teresa Stanek Rea
*Acting Director of the United States Patent and Trademark Office*